United States Patent
Van Allen et al.

(10) Patent No.: US 12,404,557 B2
(45) Date of Patent: Sep. 2, 2025

(54) BIOMARKERS PREDICTIVE OF ANTI-IMMUNE CHECKPOINT RESPONSE

(71) Applicant: Dana-Farber Cancer Institute, Inc., Boston, MA (US)

(72) Inventors: Eliezer Van Allen, Brookline, MA (US); Diana Miao, Acton, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 106 days.

(21) Appl. No.: 17/826,477

(22) Filed: May 27, 2022

(65) Prior Publication Data

US 2022/0389519 A1  Dec. 8, 2022

Related U.S. Application Data

(62) Division of application No. 16/475,577, filed as application No. PCT/US2018/012936 on Jan. 9, 2018, now Pat. No. 11,377,697.

(60) Provisional application No. 62/445,105, filed on Jan. 11, 2017.

(51) Int. Cl.
*C12Q 1/6886* (2018.01)
*G01N 33/50* (2006.01)
*G01N 33/574* (2006.01)

(52) U.S. Cl.
CPC ....... *C12Q 1/6886* (2013.01); *G01N 33/5011* (2013.01); *G01N 33/57484* (2013.01); *C12Q 2600/106* (2013.01); *C12Q 2600/156* (2013.01); *C12Q 2600/158* (2013.01)

(58) Field of Classification Search
CPC .................................................. C12Q 1/6886
USPC ...................................................... 424/174.1
See application file for complete search history.

(56) References Cited

U.S. PATENT DOCUMENTS 11,377,697 B2  7/2022  Van Allen et al.

FOREIGN PATENT DOCUMENTS

| WO | WO-2015/164743 A2 | 10/2015 |
| WO | WO-2016/196298 A1 | 12/2016 |
| WO | WO-2017/151502 A1 | 9/2017 |
| WO | WO-2017/161208 A1 | 9/2017 |
| WO | WO-2018/132369 A1 | 7/2018 |

OTHER PUBLICATIONS

Gumuskaya et al.(Cancer Genetics and Cytogenetics, 2010, 203: 222-229).*
Hodis et al., "A Landscape of Driver Mutations in Melanoma," Cell, 150(2): 251-263 (2012).
International Search Report and Written Opinion for International Application No. PCT/US18/12936 dated Apr. 13, 2018.
Kardos et al., "Claudin-low bladder tumors are immune infiltrated and actively immune suppressed," JCI Insight, 1(3): 1-17 (2016).
Li et al., "Inactivating mutations of the chromatin remodeling gen ARID2 in hepatocellular carcinoma," Nature Genetics, 43(9): 828-829 (2011).
Manceua et al., "Recurrent inactivating mutations of ARID2 in non-small cell lung carcinoma," Int. J. Cancer, 132: 2217-2221 (2013).
Saleh et al., "Ibrutinib downregulates a subset of miRNA leading to upregulation of tumor suppressors and inhibition of cell proliferation in chronic lymphocytic leukemia," Leukemia, 31: 340-349 (2017).
Tockman et al., "Considerations in Bringing a Cancer Biomarker to Clinical Application," Cancer Research, 52:2711s-2718s (1992).
Warner et al., "Clinicopathological and Targeted Exome Gene Features of a Patient with Metastatic Acinic Cell Carcinoma of the Parotid Gland Harboring an ARID2 Nonsense Mutation and CDKN2A/B Deletion," Case Reports in Oncological Medicine, vol. 2015: Article 893694 (8 pages) (2015).

* cited by examiner

*Primary Examiner* — Sean E Aeder
(74) *Attorney, Agent, or Firm* — Foley Hoag LLP

(57) ABSTRACT

The present invention is based on the identification of novel biomarkers predictive of responsiveness to anti-immune checkpoint therapies.

18 Claims, 22 Drawing Sheets

Specification includes a Sequence Listing.

Figure 1

Included samples:
Passed whole exome sequencing quality control

| Cancer Type | Number of Pre-Treatment Tumor Samples | Source |
|---|---|---|
| Anal | 1 | DFCI (1) |
| Bladder | 13 | DFCI (9)<br>DFCI CCPM (4) |
| HNSCC | 14 | DFCI (14) |
| Lung | 67 | DFCI SU2C (31)<br>CANSEQ (1)<br>Rizvi (34 – MAF only)<br>PD-L1 (1) |
| Melanoma | 176 | BroadNext10 (5)<br>Schadendorf (97)<br>Rizwan Haq (2)<br>Snyder (34 – MAF only)<br>Hugo (34 – MAF only)<br>Zaretsky (4) |
| Sarcoma | 1 | DFCI (1) |
| Total | 272 | |

Figure 2

Quality Control

- Exclusion Criteria:
  - Limited contamination with non-patient DNA:
    - Contamination Estimation (ContEst) < 5%
  - Limited admixture between tumor and normal DNA:
    - CopyNumberQC < 5 mix-ups
  - Mean target coverage:
    - Tumor: <25x
    - Normal: <15x
  - Estimated purity (ABSOLUTE) <10%
- Inclusion Criteria:
  - At least 1 clonal driver mutation (Tamborero et al. 2013)
    - RCC-CA209009_5_73 included despite not having any clonal driver mutations
  - Sequencing from pre-treatment patient tumor: Excluded on-treatment and post-treatment tumors from Snyder et al. and Hugo et al.
  - Patient received immune checkpoint therapy without combination targeted therapy (e.g. vemurafenib, dacarbazine, carboplatin, etc.)
    - Patients receiving combination immune checkpoint therapy (e.g. anti-PD1 blockade with anti-CTLA4 blockade) were included

Figure 3

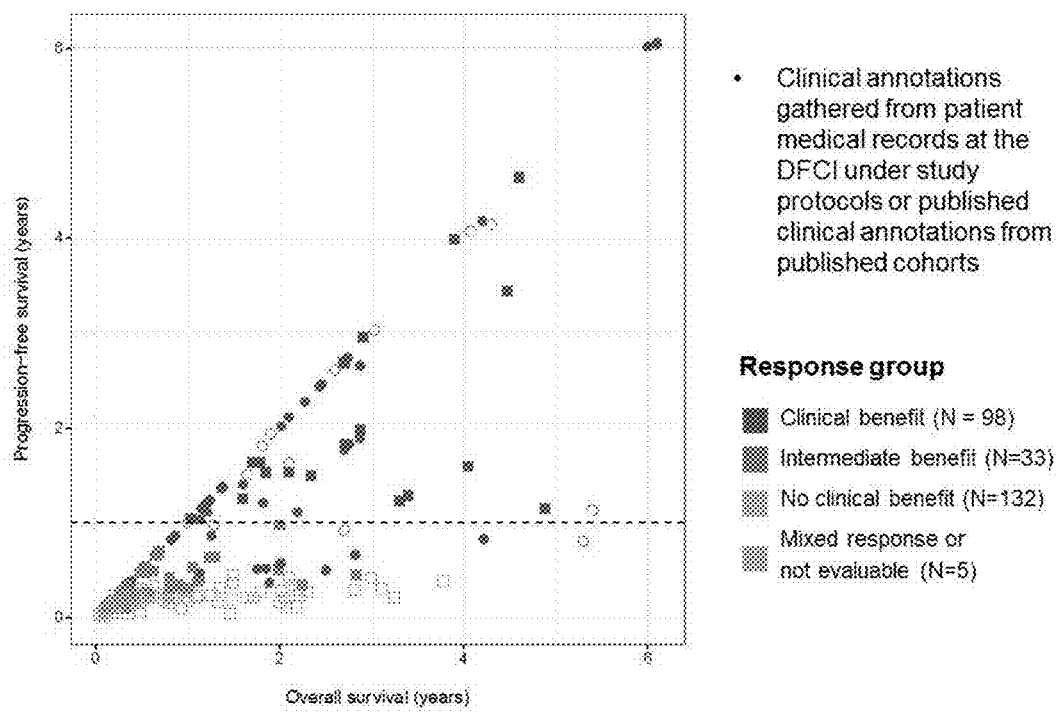

Clinical benefit from immune checkpoint therapy
N=268 patients   *36 not shown due to incomplete survival data

- Clinical annotations gathered from patient medical records at the DFCI under study protocols or published clinical annotations from published cohorts

Response group

- Clinical benefit (N = 98)
- Intermediate benefit (N=33)
- No clinical benefit (N=132)
- Mixed response or not evaluable (N=5)

SWI/SNF Complex

- SWI/SNF complex: ATP-dependent chromatin remodeling complexes mutated in >20% of human cancers
  - BAF:
    - BAF250A (ARID1A)
    - BAF250B (ARID1B)
    - BAF57 (SMARCE1)
    - BAF190/BRM (SMARCA2)
    - BAF47 (SMARCB1)
    - BAF53A (ACTL6A)
  - PBAF:
    - BAF200 (ARID2)
    - BAF180 (PBRM1)
    - BRD7
    - BAF45A (PHF10)
  - Shared:
    - BRG1/BAF190 (SMARCA4)
    - BAF155 (SMARCC1)
    - BAF170 (SMARCC2)

BAF      PBAF

Figure 13
A
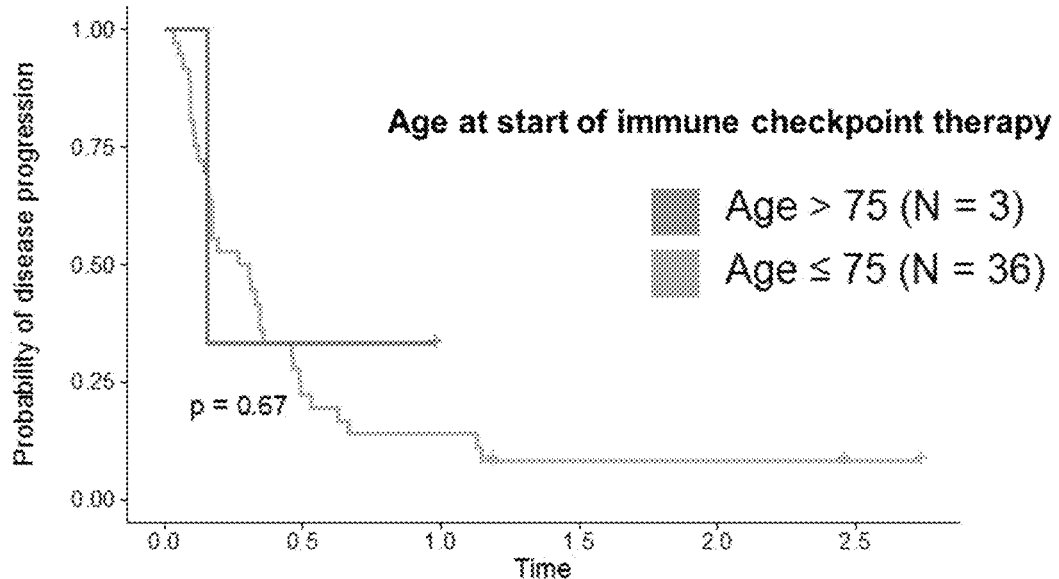
B
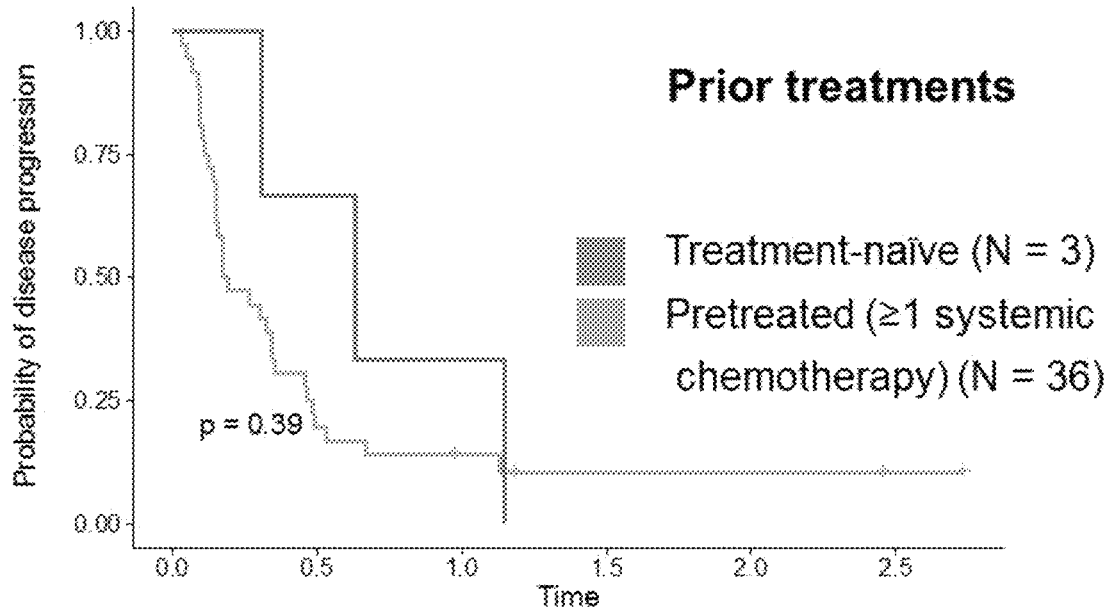

Figure 13 (cont.)
C
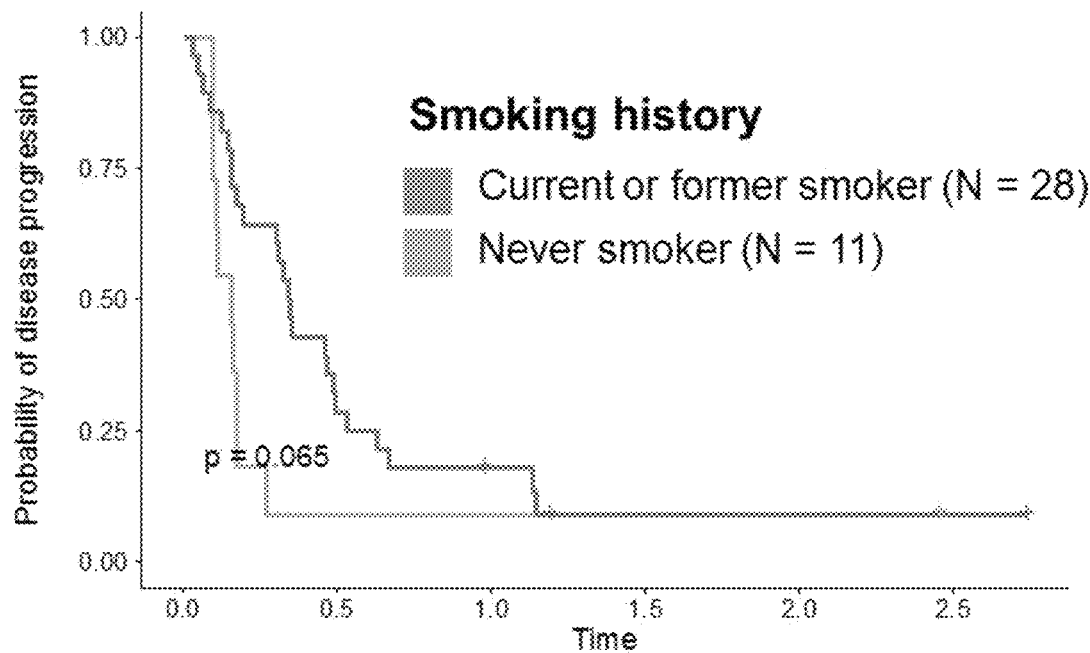
D
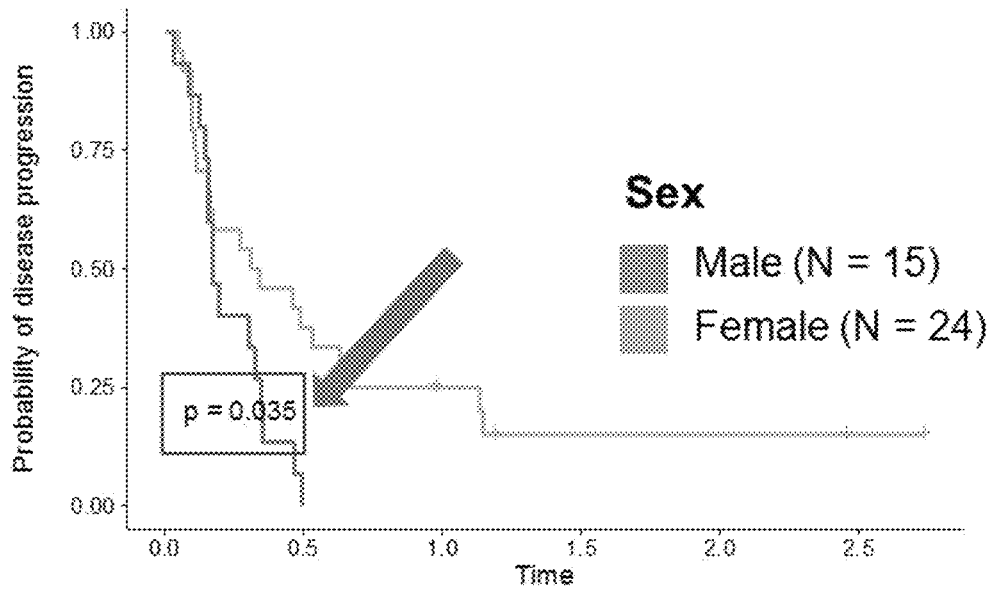

Figure 14

Quality Control 39 pre-treatment tumors underwent whole exome sequencing

ContEst: Evaluation for sample contamination with non-patient genomic material (<10%)
- 1 patient excluded: SU2C-1009 (SD)

CopyNumberQC: Evaluation for normal contamination in tumor sample (<5 mix-ups)
- 1 patient excluded: LUAD-BS-12-M17368 (PR)

Mean target coverage: Evaluation for adequate sequencing coverage to detect mutations (MTC > 30x for tumor and 15x for normal)
- 2 patients excluded: SU2C-1012 (PR), SU2C-1014 (PD)
  - 2nd pre-treatment tumor from LUAD-1011 also excluded

ABSOLUTE: Evaluation for adequate sample purity to detect somatic mutations (>10% tumor cells)
- 4 patients excluded: SU2C-1019 (PD), SU2C-1015 (PD), SU2C-1008 (PD), SU2C-1001 (SD)

31 pre-treatment tumors included in final analysis
- Plus 1 additional pre-treatment tumor from LUAD-1007 and 3 additional post-progression tumors from LUAD-1020

BIOMARKERS PREDICTIVE OF ANTI-IMMUNE CHECKPOINT RESPONSE

CROSS-REFERENCE TO RELATED APPLICATIONS

This application claims the benefit of U.S. Provisional Application No. 62/445,105, filed on 11 Jan. 2017; the entire contents of said application are incorporated herein in their entirety by this reference.

BACKGROUND OF THE INVENTION

Immune checkpoint therapies can yield durable responses and long-lasting survival benefit across some cancer types (Topalian et al. (2015) *Cancer Cell* 27:450-461). Indeed, checkpoint therapies have been approved for use in metastatic melanoma, non-small cell lung cancer, bladder cancer, and renal cell carcinoma, including as a first-line therapy for non-small cell lung cancer. However, many subjects among a population of subjects having the same cancer type do not exhibit a therapeutic benefit or relapse despite being treated with the same immune checkpoint therapy. It is presently unclear which factors associated with a cancer or type thereof, such as mutational load, neoantigen presentation, transcriptomic signatures, microbiome features, immune cell infiltration, or other indicators, are predictive of response to immune checkpoint therapies. Accordingly, there remains a great need in the art to identify biomarkers predictive of immune checkpoint therapy in order to better treat cancer of subjects in need thereof.

SUMMARY OF THE INVENTION

The present invention is based, at least in part, on the discovery that alterations in multiple oncogenic signaling pathways, including SWI/SNF pathway but also other chromatin modifiers, such as KDM6A, and EGFR signaling, predict response or resistance to immune checkpoint therapies, including (but not limited to) monoclonal antibodies targeting PD-1, PD-L1, and CTLA-4, across multiple cancer types. The SWI/SNF chromatin remodeling complex, which contains ARID1A, ARID1B, ARID2, SMARCA2, SMARCA4, SMARCB1, and PBRM1 subunits, among other subunits, plays a role in replication, transcription, DNA repair, and control of cell proliferation and differentiation. Although alterations in SWI/SNF subunits are known to play a role in the pathogenesis of ~20% of human cancers, including clear cell renal cell carcinoma, lung cancer, squamous cell carcinomas, hepatocellular carcinoma, small cell lung cancer, colorectal cancer, and pancreatic cancer (Kadoch and Crabtree (2015) *Sci. Adv.* 1:e150047), it was heretofore unknown that a mutation in one or more subunits of the SWI/SNF complex (e.g., mutations in one or more subunits of the PBAF complex, such as PBRM1 and ARID2), is predictive of response to immune checkpoint inhibitors. The same lack of predictive response applies to mutations in certain chromatin modifiers, such as KDM6A, and certain EGFR signaling components described herein. Since mutations in certain SWI/SNF complex subunits, chromatin modifiers, and/or EGFR signaling components described herein are found within a variety of cancers and types thereof, including bladder cancer, renal cell carcinoma, lung cancer, and head and neck squamous cell carcinoma, these biomarkers have wide-ranging implications for patient stratification for immune checkpoint therapy across a wide variety of hyperproliferative disorders.

In one aspect, a method of identifying the likelihood of a cancer in a subject to be responsive to an immune checkpoint therapy, the method comprising a) obtaining or providing a subject sample from a patient having cancer; b) measuring the amount or activity of at least one biomarker listed in Table 1 in the subject sample; and c) comparing said amount or activity of the at least one biomarker listed in Table 1 in a control sample, wherein the absence of or a significantly decreased amount or activity of the at least one biomarker listed in Table 1 in the subject sample and/or the presence of or a significantly increased amount or activity of the at least one biomarker listed in Table 1 having a loss of function mutation in the subject sample, relative to the control sample identifies the cancer as being more likely to be responsive to the immune checkpoint therapy; and wherein the presence of or a significantly increased amount or activity of the at least one biomarker listed in Table 1 in the subject sample and/or the absence of or a decreased amount or activity of the at least one biomarker listed in Table 1 having a loss of function mutation in the subject sample, relative to the control sample identifies the cancer as being less likely to be responsive to the immune checkpoint therapy, is provided.

In another aspect, a method of identifying the likelihood of a cancer in a subject to be responsive to immune checkpoint therapy, the method comprising a) obtaining or providing a subject sample from a patient having cancer, wherein the sample comprises nucleic acid molecules from the subject; b) determining the copy number of at least one biomarker listed in Table 1 in the subject sample; and c) comparing said copy number to that of a control sample, wherein a decreased copy number of the at least one biomarker listed in Table 1 in the in the subject sample and/or an increased copy number of the at least one biomarker listed in Table 1 having a loss of function mutation in the subject sample, relative to the control sample identifies the cancer as being more likely to be responsive to the immune checkpoint therapy; and wherein a wild type or increased copy number of the biomarker in the subject sample and/or or a decreased copy number of the at least one biomarker listed in Table 1 having a loss of function mutation in the sample relative to the control sample identifies the cancer as being less likely to be responsive to the immune checkpoint therapy, is provided.

Numerous embodiments are further provided that can be applied to any aspect of the present invention and/or combined with any other embodiment described herein. For example, in one embodiment, the method provided herein further comprises recommending, prescribing, or administering the immune checkpoint therapy if the cancer is determined likely to be responsive to the immune checkpoint therapy or administering an anti-cancer therapy other than the immune checkpoint therapy if the cancer is determined be less likely to be responsive to the immune checkpoint therapy. The anti-cancer therapy may be, for example, selected from the group consisting of targeted therapy, chemotherapy, radiation therapy, and/or hormonal therapy. In another embodiment, the control sample described herein is determined from a cancerous or non-cancerous sample from either the patient or a member of the same species to which the patient belongs. In still another embodiment, the control sample is a cancerous or non-cancerous sample from the patient obtained from an earlier point in time than the patient sample. In yet another embodiment, the control sample is obtained before the patient has received immune checkpoint therapy and the patient sample is obtained after the patient has received immune checkpoint therapy. In another embodiment, the control sample described herein comprises cells or does not comprise cells. In still another embodiment, the control sample comprises cancer cells known to be responsive or non-responsive to the immune checkpoint therapy.

In another aspect, a method of assessing the efficacy of an agent for treating a cancer in a subject that is unlikely to be responsive to an immune checkpoint therapy, comprising a) detecting in a first subject sample and maintained in the presence of the agent the amount or activity of at least one biomarker listed in Table 1; b) detecting the amount or activity of the at least one biomarker listed in Table 1 in a second subject sample and maintained in the absence of the test compound; and c) comparing the amount or activity of the at least one biomarker listed in Table 1 from steps a) and b), wherein the presence of or a significantly increased amount or activity of the at least one biomarker listed in Table 1 in the first subject sample and/or the absence of or a decreased amount or activity of the at least one biomarker listed in Table 1 having a loss of function mutation in the first subject sample, relative to at least one subsequent subject sample, indicates that the agent treats the cancer in the subject, is provided.

In another aspect, a method of assessing the efficacy of an agent for treating a cancer in a subject or prognosing progression of a cancer in a subject, comprising a) detecting in a subject sample at a first point in time the amount or activity of at least one biomarker listed in Table 1; b) repeating step a) during at least one subsequent point in time after administration of the agent; and c) comparing the expression and/or activity detected in steps a) and b), wherein the presence of or a significantly increased amount or activity of the at least one biomarker listed in Table 1 in the first subject sample and/or the absence of or a decreased amount or activity of the at least one biomarker listed in Table 1 having a loss of function mutation in the first subject sample, relative to at least one subsequent subject sample, indicates that the cancer is unlikely to progress or that the agent treats the cancer in the subject, is provided. In one embodiment, between the first point in time and the subsequent point in time, the subject has undergone treatment, completed treatment, and/or is in remission for the cancer. In another embodiment, the first and/or at least one subsequent sample is selected from the group consisting of ex vivo and in vivo samples. In still another embodiment, the first and/or at least one subsequent sample is obtained from an animal model of the cancer. In yet another embodiment, the first and/or at least one subsequent sample is a portion of a single sample or pooled samples obtained from the subject.

In another aspect, a cell-based assay for screening for agents that have a cytotoxic or cytostatic effect on a cancer cell that is unresponsive to an immune checkpoint therapy comprising, contacting the cancer cell with a test agent, and determining the ability of the test agent to decrease the amount or activity of at least one biomarker listed in Table 1 in the subject sample and/or increase the amount or activity of the at least one biomarker listed in Table 1 having a loss of function mutation, is provided. In one embodiment, the step of contacting occurs in vivo, ex vivo, or in vitro. In another embodiment, the subject sample and/or the control sample has not been contacted with any anti-cancer treatment or inhibitor of an immune checkpoint. In still another embodiment, the subject has not been administered any anti-cancer treatment or inhibitor of an immune checkpoint.

In yet another embodiment, the method or the cell-based assay provided herein further comprises recommending, prescribing, or administering at least one additional anti-cancer therapeutic agent. In another embodiment, the at least one additional anti-cancer therapeutic agent comprises an anti-PD-1 antibody and/or an anti-CTLA4 antibody.

As described above, numerous embodiments are contemplated for any aspect of the present invention described herein. For example, in one embodiment, the subject sample is selected from the group consisting of serum, whole blood, plasma, urine, cells, cell lines, and biopsies. In another embodiment, the amount of the at least one biomarker listed in Table 1 is detected using a reagent which specifically binds with the protein. For example, the reagent may be selected from the group consisting of an antibody, an antibody derivative, and an antibody fragment. In still another embodiment, the at least one biomarker listed in Table 1 is assessed by detecting the presence in the sample of a transcribed polynucleotide or portion thereof. For example, the transcribed polynucleotide may be an mRNA or a cDNA. The transcribed polynucleotide cam be detected by identifying a nucleic acid that anneals with the biomarker nucleic acid, or a portion thereof, under stringent hybridization conditions. In yet another embodiment, the step of detecting further comprises amplifying the transcribed polynucleotide. In another embodiment, the at least one biomarker listed in Table 1 is human PBRM1, ARID2, BRD7, PHF10, KDM6A, ARID1A, ARID1B, BRG1, BRM, CRB1, or EGFR, or a fragment thereof. In still another embodiment, the immune checkpoint therapy described herein comprises at least one antibody selected from the group consisting of anti-PD-1 antibodies, anti-CTLA-4 antibodies, anti-PD-L1 antibodies, anti-PD-L2 antibodies, and combinations thereof. For example, the immune checkpoint therapy may comprise an anti-PD-1 antibody and/or an anti-CTLA4 antibody. In yet another embodiment, the likelihood of the cancer in the subject to be responsive to immune checkpoint therapy is the likelihood of at least one criteria selected from the group consisting of cellular proliferation, tumor burden, m-stage, metastasis, progressive disease, clinical benefit rate, survival until mortality, pathological complete response, semi-quantitative measures of pathologic response, clinical complete remission, clinical partial remission, clinical stable disease, recurrence-free survival, metastasis free survival, disease free survival, circulating tumor cell decrease, circulating marker response, and RECIST criteria. In another embodiment, the cancer is a solid tumor. In still another embodiment, the cancer is selected from the group consisting of melanoma, lung cancer, head and neck squamous cell carcinoma (HNSCC), sarcoma, bladder cancer, and renal cell cancer. In another embodiment, the cancer is melanoma. In still another embodiment, the cancer is metastatic. In still another embodiment, the subject described herein is a mammal. In yet another embodiment, the mammal is an animal model of cancer. In another embodiment, the mammal is a human.

BRIEF DESCRIPTION OF FIGURES

FIG. 1 summarizes the different types of cancer samples and their sources for analysis.

FIG. 2 depicts two criteria (exclusion and inclusion) for selecting quality controls for analysis.

FIG. 3 depicts that different patients had different degrees of clinical benefit from immune checkpoint therapy.

FIG. 13 includes 4 panels, identified as panels A, B, C, and D, which show the Kaplan-Meier analysis result for baseline clinical variables as predictors of PFS for SU2C cohort (N=39).

FIG. 14 shows the quality control processes for analyzing the SU2C cohort.

DETAILED DESCRIPTION OF THE INVENTION

Figure 4:
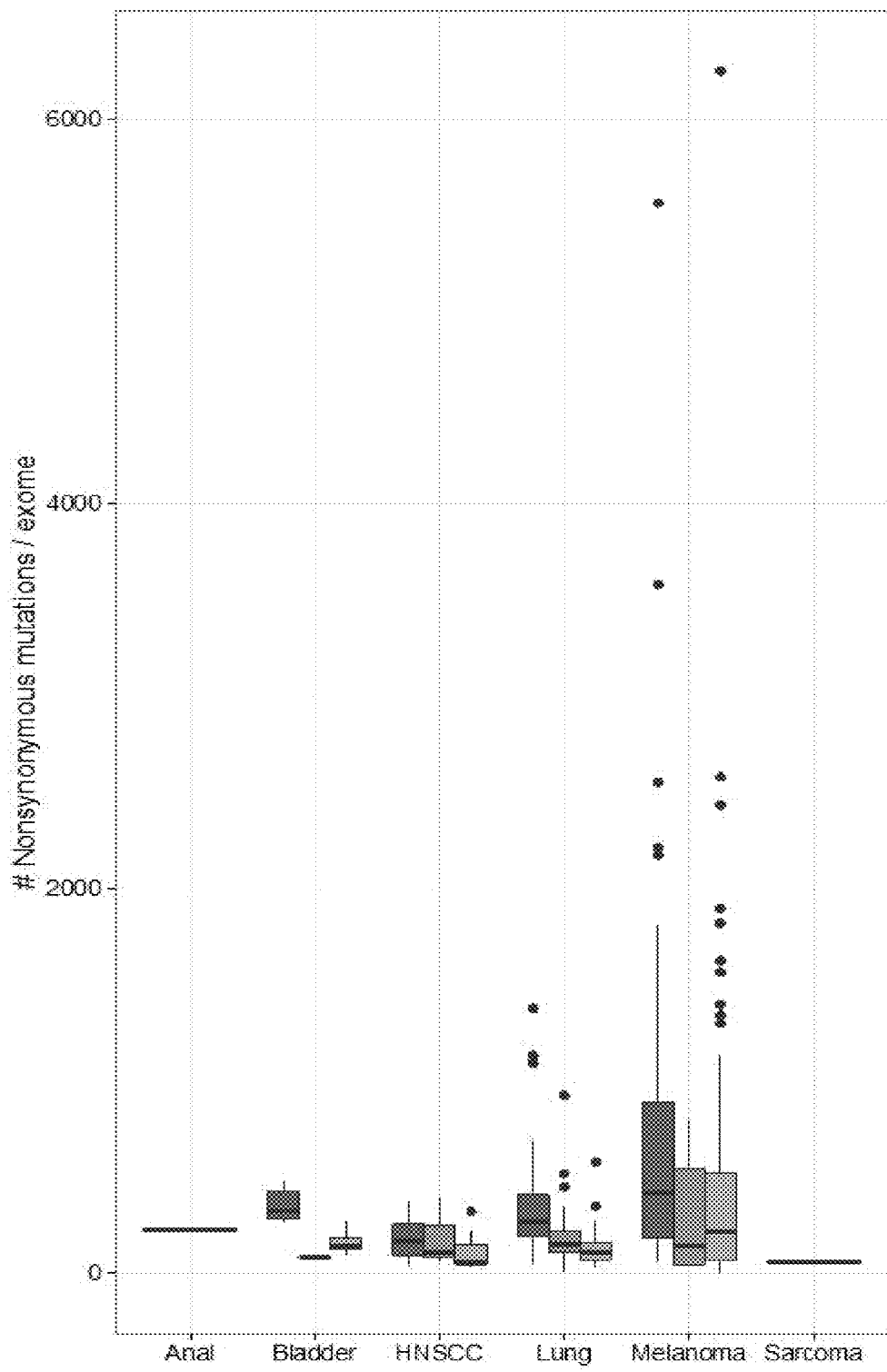
FIG. 4 compares the amount of nonsynonymous mutations in patients having different degrees of clinical benefit from immune checkpoint therapy.

It has been determined herein that certain SWI/SNF complex subunits (e.g., PBRM1, ARID2, and other SWI/SNF complex subunits described herein, such as in the Tables and Examples), additional chromatin modifiers (e.g., such as KDM6A), and EGFR signaling components are specific biomarkers for predicted clinical outcome in a wide variety of cancers afflicting patients who have received anti-immune checkpoint-based therapy (e.g., anti-PD1 and/or anti-CTLA4 agents). Accordingly, the present invention relates, in part, to methods for stratifying patients and predicting response of a cancer in a subject to immune checkpoint therapy based upon a determination and analysis of mutations, described herein, of biomarkers, compared to a control. In addition, such analyses can be used in order to provide useful anti-immune checkpoint treatment regimens (e.g., based on predictions of clinical response, subject survival or relapse, timing of adjuvant or neoadjuvant treatment, etc.).

I. Definitions

The articles "a" and "an" are used herein to refer to one or to more than one (i.e. to at least one) of the grammatical object of the article. By way of example, "an element" means one element or more than one element.

The term "altered amount" or "altered level" refers to increased or decreased copy number (e.g., germline and/or somatic) of a biomarker nucleic acid, e.g., increased or decreased expression level in a cancer sample, as compared to the expression level or copy number of the biomarker nucleic acid in a control sample. The term "altered amount" of a biomarker also includes an increased or decreased protein level of a biomarker protein in a sample, e.g., a cancer sample, as compared to the corresponding protein level in a normal, control sample. Furthermore, an altered amount of a biomarker protein may be determined by detecting posttranslational modification such as methylation status of the marker, which may affect the expression or activity of the biomarker protein.

The amount of a biomarker in a subject is "significantly" higher or lower than the normal amount of the biomarker, if the amount of the biomarker is greater or less, respectively, than the normal level by an amount greater than the standard error of the assay employed to assess amount, and preferably at least 20%, 30%, 40%, 50%, 60%, 70%, 80%, 90%, 100%, 150%, 200%, 300%, 350%, 400%, 500%, 600%, 700%, 800%, 900%, 1000% or than that amount. Such "significance" can be assessed from any desired or known point of comparison, such as a particular post-treatment versus pre-treatment biomarker measurement ratio (e.g., 1-fold, 1.1-fold, 1.2-fold, 1.3-fold, 1.4-fold, 1.5-fold, and the like) or a particular pre-treatment serum biomarker protein measurement (e.g., 2,500 pg/ml, 2,750 pg/ml, 3,000 pg/ml, 3,175 pg/ml, 3,250 pg/ml, 3,500 pg/ml, and the like). Alternately, the amount of the biomarker in the subject can be considered "significantly" higher or lower than the normal amount if the amount is at least about two, and preferably at least about three, four, or five times, higher or lower, respectively, than the normal amount of the biomarker. Such "significance" can also be applied to any other measured parameter described herein, such as for expression, inhibition, cytotoxicity, cell growth, and the like.

The term "altered level of expression" of a biomarker refers to an expression level or copy number of the biomarker in a test sample, e.g., a sample derived from a patient suffering from cancer, that is greater or less than the standard error of the assay employed to assess expression or copy number, and is preferably at least twice, and more preferably three, four, five or ten or more times the expression level or copy number of the biomarker in a control sample (e.g., sample from a healthy subjects not having the associated disease) and preferably, the average expression level or copy number of the biomarker in several control samples. The altered level of expression is greater or less than the standard error of the assay employed to assess expression or copy number, and is preferably at least 20%, 30%, 40%, 50%, 60%, 70%, 80%, 90%, 100%, 150%, 200%, 300%, 350%, 400%, 500%, 600%, 700%, 800%, 900%, 1000% or more times the expression level or copy number of the biomarker in a control sample (e.g., sample from a healthy subjects not having the associated disease) and preferably, the average expression level or copy number of the biomarker in several control samples.

The term "altered activity" of a biomarker refers to an activity of the biomarker which is increased or decreased in a disease state, e.g., in a cancer sample, as compared to the activity of the biomarker in a normal, control sample. Altered activity of the biomarker may be the result of, for example, altered expression of the biomarker, altered protein level of the biomarker, altered structure of the biomarker, or, e.g., an altered interaction with other proteins involved in the same or different pathway as the biomarker or altered interaction with transcriptional activators or inhibitors.

The term "altered structure" of a biomarker refers to the presence of mutations or allelic variants within a biomarker nucleic acid or protein, e.g., mutations which affect expression or activity of the biomarker nucleic acid or protein, as compared to the normal or wild-type gene or protein. For example, mutations include, but are not limited to substitutions, deletions, or addition mutations. Mutations may be present in the coding or non-coding region of the biomarker nucleic acid.

Figure 9:
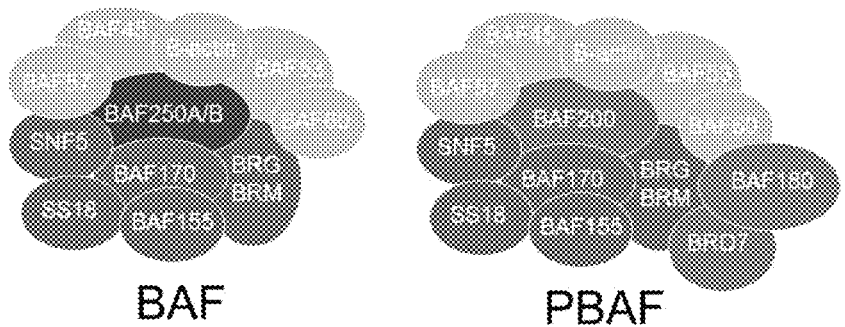
FIG. 9 depicts protein subunits of the SWI/SNF protein complex.

The term "SWI/SNF complex" refers to SWItch/Sucrose Non-Fermentable, a nucleosome remodeling complex found in both eukaryotes and prokaryotes (Neigeborn Carlson (1984) *Genetics* 108:845-858; Stem et al. (1984) *J Mol. Biol.* 178:853-868). The SWI/SNF complex was first discovered in the yeast, *Saccharomyces cerevisiae*, named after yeast mating types switching (SWI) and sucrose nonfermenting (SNF) pathways (Workman and Kingston (1998) *Annu Rev Biochem.* 67:545-579; Sudarsanam and Winston (2000) *Trends Genet.* 16:345-351). It is a group of proteins comprising, at least, SWI1, SWI2/SNF2, SWI3, SWI5, and SWI6, as well as other polypeptides (Pazin and Kadonaga (1997) *Cell* 88:737-740). A genetic screening for suppressive mutations of the SWI/SNF phenotypes identified different histones and chromatin components, suggesting that these proteins were possibly involved in histone binding and chromatin organization (Winston and Carlson (1992) *Trends Genet.* 8:387-391). Biochemical purification of the SWI/SNF2p in *S. cerevisiae* demonstrated that this protein was part of a complex containing an additional 11 polypeptides, with a combined molecular weight over 1.5 MDa. The SWI/SNF complex contains the ATPase Swi2/Snf2p, two actin-related proteins (Arp7p and Arp9) and other subunits involved in DNA and protein-protein interactions. The purified SWI/SNF complex was able to alter the nucleosome structure in an ATP-dependent manner (Workman and Kingston (1998), supra; Vignali et al. (2000) *Mol Cell Biol.* 20:1899-1910). The structures of the SWI/SNF and RSC complexes are highly conserved but not identical, reflecting an increasing complexity of chromatin (e.g., an increased genome size, the presence of DNA methylation, and more complex genetic organization) through evolution. For this reason, the SWI/SNF complex in higher eukaryotes maintains core components, but also substitute or add on other components with more specialized or tissue-specific domains. Yeast contains two distinct and similar remodeling complexes, SWI/SNF and RSC (Remodeling the Structure of Chromatin). In *Drosophila*, the two complexes are called BAP (Brahma Associated Protein) and PBAP (Polybromo-associated BAP) complexes. The human analogs are BAF (Brgl Associated Factors, or SWI/SNF-A) and PBAF (Polybromo-associated BAF, or SWI/SNF-B). As shown in FIG. 9, the BAF complex comprises, at least, BAF250A (ARID1A), BAF250B (ARID1B), BAF57 (SMARCE1), BAF190/BRM (SMARCA2), BAF47 (SMARCB1), BAF53A (ACTL6A), BRG1/BAF190 (SMARCA4), BAF155 (SMARCC1), and BAF170 (SMARCC2). The PBAF complex comprises, at last, BAF200 (ARID2), BAF180 (PBRM1), BRD7, BAF45A (PHF10), BRG1/BAF190 (SMARCA4), BAF155 (SMARCC1), and BAF170 (SMARCC2). As in *Drosophila*, human BAF and PBAF share the different core components BAF47, BAF57, BAF60, BAF155, BAF170, BAF45 and the two actins b-Actin and BAF53 (Mohrmann and Verrijzer (2005) *Biochim Biophys Acta.* 1681:59-73). The central core of the BAF and PBAF is the ATPase catalytic subunit BRG1/hBRM, which contains multiple domains to bind to other protein subunits and acetylated histones. For a summary of different complex subunits and their domain structure, see Tang et al. (2010) *Prog Biophys Mol Biol.* 102:122-128 (e.g., FIG. 3), Hohmann and Vakoc (2014) *Trends Genet.* 30:356-363 (e.g., FIG. 1), and Kadoch and Crabtree (2015) *Sci. Adv.* 1:e1500447. For chromatin remodeling, the SWI/SNF complex use the energy of ATP hydrolysis to slide the DNA around the nucleosome. The first step consists in the binding between the remodeler and the nucleosome. This binding occurs with nanomolar affinity and reduces the digestion of nucleosomal DNA by nucleases. The 3-D structure of the yeast RSC complex was first solved and imaged using negative stain electron microscopy (Asturias et al. (2002) *Proc Natl Acad Sci USA* 99:13477-13480). The first Cryo-EM structure of the yeast SWI/SNF complex was published in 2008 (Dechassa et al. 2008). DNA footprinting data showed that the SWI/SNF complex makes close contacts with only one gyre of nucleosomal DNA. Protein crosslinking showed that the ATPase SWI2/SNF2p and Swi5p (the homologue of Inilp in human), Snf6, Swi29, Snf11 and Sw82p (not conserved in human) make close contact with the histones. Several individual SWI/SNF subunits are encoded by gene families, whose protein products are mutually exclusive in the complex (Wu et al. (2009) *Cell* 136: 200-206). Thus, only one paralog is incorporated in a given SWI/SNF assembly. The only exceptions are BAF155 and BAF170, which are always present in the complex as homo- or hetero-dimers. Combinatorial association of SWI/SNF subunits could in principle give rise to hundreds of distinct complexes, although the exact number has yet to be determined (Wu et al. (2009), supra). Genetic evidence suggests that distinct subunit configurations of SWI/SNF are equipped to perform specialized functions. As an example, SWI/SNF contains one of two ATPase subunits, BRG1 or BRM/SMARCA2, which share 75% amino acid sequence identity (Khavari et al. (1993) *Nature* 366:170-174). While in certain cell types BRG1 and BRM can compensate for loss of the other subunit, in other contexts these two ATPases perform divergent functions (Strobeck et al. (2002) *J Biol Chem.* 277:4782-4789; Hoffman et al. (2014) *Proc Natl Acad Sci USA.* 111:3128-3133). In some cell types, BRG1 and BRM can even functionally oppose one another to regulate differentiation (Flowers et al. (2009) *J Biol Chem.* 284:10067-10075). The functional specificity of BRG1 and BRM has been linked to sequence variations near their N-terminus, which have different interaction specificities for transcription factors (Kadam and Emerson (2003) *Mol Cell.* 11:377-389). Another example of paralogous subunits that form mutually exclusive SWI/SNF complexes are ARID1A/BAF250A, ARID1B/BAF250B, and ARID2/BAF200. ARID1A and ARID1B share 60% sequence identity, but yet can perform opposing functions in regulating the cell cycle, with MYC being an important downstream target of each paralog (Nagl et al. (2007) *EMBO J.* 26:752-763). ARID2 has diverged considerably from ARID1A/ARID1B and exists in a unique SWI/SNF assembly known as PBAF (or SWI/SNF-B), which contains several unique subunits not found in ARID1A/B-containing complexes. The composition of SWI/SNF can also be dynamically reconfigured during cell fate transitions through cell type-specific expression patterns of certain subunits. For example, BAF53A/ACTL6A is repressed and replaced by BAF53B/ACTL6B during neuronal differentiation, a switch that is essential for proper neuronal functions in vivo (Lessard et al. (2007) *Neuron* 55:201-215). These studies stress that SWI/SNF in fact represents a collection of multi-subunit complexes whose integrated functions control diverse cellular processes, which is also incorporated in the scope of definitions of the instant disclosure. Two recently published meta-analyses of cancer genome sequencing data estimate that nearly 20% of human cancers harbor mutations in one (or more) of the genes encoding SWI/SNF (Kadoch et al. (2013) *Nat Genet.* 45:592-601; Shain and Pollack (2013) *PLoS One.* 8:e55119). Such mutations are generally loss-of-function, implicating SWI/SNF as a major tumor suppressor in diverse cancers. Specific SWI/SNF gene mutations are generally linked to a specific subset of cancer lineages: SNF5 is mutated in malignant rhabdoid tumors (MRT), PBRM1/BAF180 is frequently inactivated in renal carcinoma, and BRG1 is mutated in non-small cell lung cancer (NSCLC) and several other cancers. In the instant disclosure, the scope of "SWI/SNF complex" may cover at least one fraction or the whole complex (e.g., some or all subunit proteins/other components), either in the human BAF/PBAF forms or their homologs/orthologs in other species (e.g., the yeast and drosophila forms described herein). Preferably, a "SWI/SNF complex" described herein contains at least part of the full complex bio-functionality, such as binding to other subunits/components, binding to DNA/histone, catalyzing ATP, promoting chromotin remodeling, etc.

The term "BAF complex" refers to at least one type of mammalian SWI/SNF complexes. Its nucleosome remodeling activity can be reconstituted with a set of four core subunits (BRG1/SMARCA4, SNF5/SMARCB1, BAF155/SMARCC1, and BAF170/SMARCC2), which have orthologs in the yeast complex (Phelan et al. (1999) *Mol Cell.* 3:247-253). However, mammalian SWI/SNF contains several subunits not found in the yeast counterpart, which can provide interaction surfaces for chromatin (e.g. acetyl-lysine recognition by bromodomains) or transcription factors and thus contribute to the genomic targeting of the complex (Wang et al. (1996) *EMBO J* 15:5370-5382; Wang et al. (1996) *Genes Dev.* 10:2117-2130; Nie et al. (2000)). A key attribute of mammalian SWI/SNF is the heterogeneity of subunit configurations that can exist in different tissues and even in a single cell type (e.g., as BAF, PBAF, neural progenitor BAF (npBAF), neuron BAF (nBAF), embryonic stem cell BAF (esBAF), etc.). In some embodiments, the BAF complex described herein refers to one type of mammalian SWI/SNF complexes, which is different from PBAF complexes.

The term "PBAF complex" refers to one type of mammalian SWI/SNF complexes originally known as SWI/SNF-B. It is highly related to the BAF complex and can be separated with conventional chromatographic approaches. For example, human BAF and PBAF complexes share multiple identical subunits (such as BRG, BAF170, BAF155, BAF60, BAF57, BAF53, BAF45, actin, SS18, and hSNF5/INI1, as illustrated in FIG. 9). However, while BAF contains BAF250 subunit, PBAF contains BAF180 and BAF200, instead (Lemon et al. (2001) *Nature* 414:924-998; Yan et al. (2005) *Genes Dev.* 19:1662-1667). Moreover, they do have selectivity in regulating interferon-responsive genes (Yan et al. (2005), supra, showing that BAF200, but not BAF180, is required for PBAF to mediate expression of IFITM1 gene induced by IFN-α, while the IFITM3 gene expression is dependent on BAF but not PBAF). Due to these differentces, PBAF, but not BAF, was able to activate vitamin D receptor-dependent transcription on a chromatinzed template in vitro (Lemon et al. (2001), supra). The 3-D structure of human PBAF complex preserved in negative stain was found to be similar to yeast RSC but dramatically different from yeast SWI/SNF (Leschziner et al. (2005) *Structure* 13:267-275).

The term "BRG" or "BRG1/BAF190 (SMARCA4)" refers to a subunit of the SWI/SNF complex, which can be find in either BAF or PBAF complex. It is an ATP-dependent helicase and a transcription activator, encoded by the SMARCA4 gene. BRG1 can also bind BRCA1, as well as regulate the expression of the tumorigenic protein CD44. BRG1 is important for development past the pre-implantation stage. Without having a functional BRG1, exhibited with knockout research, the embryo will not hatch out of the zona pellucida, which will inhibit implantation from occurring on the endometrium (uterine wall). BRG1 is also crucial to the development of sperm. During the first stages of meiosis in spermatogenesis there are high levels of BRG1. When BRG1 is genetically damaged, meiosis is stopped in prophase 1, hindering the development of sperm and would result in infertility. More knockout research has concluded BRGT's aid in the development of smooth muscle. In a BRG1 knockout, smooth muscle in the gastrointestinal tract lacks contractility, and intestines are incomplete in some cases. Another defect occurring in knocking out BRG1 in smooth muscle development is heart complications such as an open ductus arteriosus after birth (Kim et al. (2012) *Development* 139:1133-1140; Zhang et al. (2011) *Mol. Cell. Biol.* 31:2618-2631). Mutations in SMARCA4 were first recognized in human lung cancer cell lines (Medina et al. (2008) *Hum. Mut.* 29:617-622). Later it was recognized that mutations exist in a significant frequency of medulloblastoma and pancreatic cancers among other tumor subtypes (Jones et al. (2012) *Nature* 488:100-105; Shain et al. (2012) *Proc Natl Acad Sci USA* 109:E252-E259; Shain and Pollack (2013), supra). Mutations in BRG1 (or SMARCA4) appear to be mutually exclusive with the presence of activation at any of the MYC-genes, which indicates that the BRG1 and MYC proteins are functionally related. Another recent study demonstrated a causal role of BRG1 in the control of retinoic acid and glucocorticoid-induced cell differentiation in lung cancer and in other tumor types. This enables the cancer cell to sustain undifferentiated gene expression programs that affect the control of key cellular processes. Furthermore, it explains why lung cancer and other solid tumors are completely refractory to treatments based on these compounds that are effective therapies for some types of leukemia (Romero et al. (2012) *EMBO Mol. Med.* 4:603-616). The role of BRG1 in sensitivity or resistance to anti-cancer drugs had been recently highlighted by the elucidation of the mechanisms of action of darinaparsin, an arsenic-based anti-cancer drugs. Darinaparsin has been shown to induce phosphorylation of BRG1, which leads to its exclusion from the chromatin. When excluded from the chromatin, BRG1 can no longer act as a transcriptional co-regulator. This leads to the inability of cells to express HO-1, a cytoprotective enzyme. BRG1 has been shown to interact with proteins such as ACTL6A, ARID1A, ARID1B, BRCA1, CTNNB1, CBX5, CREBBP, CCNE1, ESR1, FANCA, HSP90B1, ING1, Myc, NR3C1, P53, POLR2A, PHB, SIN3A, SMARCB1, SMARCC1, SMARCC2, SMARCE1, STAT2, STK11, etc.

The term "BRG" or "BRG1/BAF190 (SMARCA4)" is intended to include fragments, variants (e.g., allelic variants), and derivatives thereof. Representative human BRG1 (SMARCA4) cDNA and human BRG1 protein sequences are well-known in the art and are publicly available from the National Center for Biotechnology Information (NCBI). For example, seven different human BRG1 isoforms are known. Human BRG1 isoform A (NP_001122321.1) is encodable by the transcript variant 1 (NM_001128849.1), which is the longest transcript. Human BRG1 isoform B (NP_001122316.1 or NP_003063.2) is encodable by the transcript variant 2 (NM_001128844.1), which differs in the 5' UTR and lacks an alternate exon in the 3' coding region, compared to the variant 1, and also by the transcript variant 3 (NM_003072.3), which lacks an alternate exon in the 3' coding region compared to variant 1. Human BRG1 isoform C (NP_001122317.1) is encodable by the transcript variant 4 (NM_001128845.1), which lacks two alternate in-frame exons and uses an alternate splice site in the 3' coding region, compared to variant 1. Human BRG1 isoform D (NP_001122318.1) is encodable by the transcript variant 5 (NM_001128846.1), which lacks two alternate in-frame exons and uses two alternate splice sites in the 3' coding region, compared to variant 1. Human BRG1 isoform E (NP_001122319.1) is encodable by the transcript variant 6 (NM_001128847.1), which lacks two alternate in-frame exons in the 3' coding region, compared to variant 1. Human BRG1 isoform F (NP_001122320.1) is encodable by the transcript variant 7 (NM_001128848.1), which lacks two alternate in-frame exons and uses an alternate splice site in the 3' coding region, compared to variant 1. Nucleic acid and polypeptide sequences of BRG1 orthologs in organisms other than humans are well known and include, for example, chimpanzee BRG1 (XM_016935029.1 and XP_016790518.1, XM_016935038.1 and XP_016790527.1, XM_016935039.1 and XP_016790528.1, XM_016935036.1 and XP_016790525.1, XM_016935037.1 and XP_016790526.1, XM_016935041.1 and XP_016790530.1, XM_016935040.1 and XP_016790529.1, XM_016935042.1 and XP_016790531.1, XM_016935043.1 and XP_016790532.1, XM_016935035.1 and XP_016790524.1, XM_016935032.1 and XP_016790521.1, XM_016935033.1 and XP_016790522.1, XM_016935030.1 and XP_016790519.1, XM_016935031.1 and XP_016790520.1, and XM_016935034.1 and XP_016790523.1), Rhesus monkey BRG1 (XM_015122901.1 and XP_014978387.1, XM_015122902.1 and XP_014978388.1, XM_015122903.1 and XP 014978389.1, XM 015122906.1 and XP 014978392.1, XM_015122905.1 and XP 014978391.1, XM_015122904.1 and XP_014978390.1, XM_015122907.1 and XP 014978393.1, XM_015122909.1 and XP_014978395.1, and XM_015122910.1 and XP_014978396.1), dog BRG1 (XM_014122046.1 and XP_013977521.1, XM_014122043.1 and XP_013977518.1, XM_014122042.1 and XP_013977517.1, XM_014122041.1 and XP_013977516.1, XM_014122045.1 and XP_013977520.1, and XM_014122044.1 and XP_013977519.1), cattle BRG1 (NM_001105614.1 and NP_001099084.1), mouse BRG1 (NM_001174078.1 and NP_001167549.1, NM_001174079.1 and NP_001167550.1, and NM_011417.3 and NP_035547.2), rat BRG1 (NM_134368.1 and NP_599195.1), chicken BRG1 (NM_205059.1 and NP_990390.1), and zebrafish BRG1 (NM_181603.1 and NP_853634.1).

Anti-BRG1 antibodies suitable for detecting BRG1 protein are well-known in the art and include, for example, MABE1118, MABE121, MABE60, and 07-478 (poly- and mono-clonal antibodies from EMD Millipore, Billerica, MA), AM26021PU-N, AP23972PU-N, TA322909, TA322910, TA327280, TA347049, TA347050, TA347851, and TA349038 (antibodies from OnGene Technologies, Rockville, MD), NB100-2594, AF5738, NBP2-22234, NBP2-41270, NBP1-51230, and NBP1-40379 (antibodes from Novus Biologicals, Littleton, CO), ab110641, ab4081, ab215998, ab108318, ab70558, ab118558, ab133257, ab92496, ab196535, and ab196315 (antibodies from AbCam, Cambridge, MA), Cat #: 720129, 730011, 730051, MA1-10062, PA5-17003, and PA5-17008 (antibodies from ThermoFisher Scientific, Waltham, MA), GTX633391, GTX32478, GTX31917, GTX16472, and GTX50842 (antibodies from GeneTex, Irvine, CA), antibody 7749 (ProSci, Poway, CA), Brg-1 (N-15), Brg-1 (N-15) X, Brg-1 (H-88), Brg-1 (H-88) X, Brg-1 (P-18), Brg-1 (P-18) X, Brg-1 (G-7), Brg-1 (G-7) X, Brg-1 (H-10), and Brg-1 (H-10) X (antibodies from Santa Cruz Biotechnology, Dallas, TX), antibody of Cat. AF5738 (R&D Systmes, Minneapolis, MN), etc. In addition, reagents are well-known for detecting BRG1 expression. Moreover, multiple siRNA, shRNA, CRISPR constructs for reducing BRG1 Expression can be found in the commercial product lists of the above-referenced companies. PFI 3 is a known small molecule inhibitor of polybromo 1 and BRG1 (e.g., Cat. B7744 from APExBIO, Houston, TX). It is to be noted that the term can further be used to refer to any combination of features described herein regarding BRG1 molecules. For example, any combination of sequence composition, percentage identify, sequence length, domain structure, functional activity, etc. can be used to describe an BRG1 molecule of the present invention.

The term "BRM" or "BRM/BAF190 (SMARCA2)" refers to a subunit of the SWI/SNF complex, which can be found in either BAF or PBAF complexes. It is an ATP-dependent helicase and a transcription activator, encoded by the SMARCA2 gene. The catalytic core of the SWI/SNF complex can be either of two closely related ATPases, BRM or BRG1, with the potential that the choice of alternative subunits is a key determinant of specificity. Instead of impeding differentiation as was seen with BRG1 depletion, depletion of BRM caused accelerated progression to the differentiation phenotype. BRM was found to regulate genes different from those as BRG1 targets and be capable of overriding BRG1-dependent activation of the osteocalcin promoter, due to its interaction with different ARID family members (Flowers et al. (2009), supra). The known binding partners for BRM include, for example, ACTL6A, ARID1B, CEBPB, POLR2A, Prohibitin, SIN3A, SMARCB1, and SMARCC1.

The term "BRM" or "BRM/BAF190 (SMARCA2)" is intended to include fragments, variants (e.g., allelic variants), and derivatives thereof. Representative human BRM (SMARCA2) cDNA and human BRM protein sequences are well-known in the art and are publicly available from the National Center for Biotechnology Information (NCBI). For example, seven different human BRM isoforms are known. Human BRM isoform A (NP_003061.3 or NP_001276325.1) is encodable by the transcript variant 1 (NM_003070.4), which is the longest transcript, or the transcript variant 3 (NM_001289396.1), which differs in the 5' UTR, compared to variant 1. Human BRM isoform B (NP_620614.2) is encodable by the transcript variant 2 (NM_139045.3), which lacks an alternate in-frame exon in the coding region, compared to variant 1. Human BRM isoform C (NP_001276326.1) is encodable by the transcript variant 4 (NM_001289397.1), which uses an alternate in-frame splice site and lacks an alternate in-frame exon in the 3' coding region, compared to variant 1. Human BRM isoform D (NP_001276327.1) is encodable by the transcript variant 5 (NM_001289398.1), which differs in the 5' UTR, lacks a portion of the 5' coding region, and initiates translation at an alternate downstream start codon, compared to variant 1. Human BRM isoform E (NP_001276328.1) is encodable by the transcript variant 6 (NM_001289399.1), which differs in the 5' UTR, lacks a portion of the 5' coding region, and initiates translation at an alternate downstream start codon, compared to variant 1. Human BRM isoform F (NP_001276329.1) is encodable by the transcript variant 7 (NM_001289400.1), which differs in the 5' UTR, lacks a portion of the 5' coding region, and initiates translation at an alternate downstream start codon, compared to variant 1. Nucleic acid and polypeptide sequences of BRM orthologs in organisms other than humans are well known and include, for example, chimpanzee BRM (XM_016960529.1 and XP_016816018.1), dog BRG1 (XM_005615906.2 and XP_005615963.1, XM_845066.4 and XP_850159.1, XM_005615905.2 and XP 005615962.1, XM_005615904.2 and XP_005615961.1, XM_005615903.2 and XP_005615960.1, and XM_005615902.2 and XP_005615959.1), cattle BRM (NM_001099115.2 and NP_001092585.1), mouse BRM (NM_001347439.1 and NP 001334368.1, NM_011416.2 and NP_035546.2, and NM_026003.2 and NP_080279.1), rat BRM (NM_001004446.1 and NP_001004446.1), chicken BRM (NM_205139.1 and NP_990470.1), tropical clawed frog BRM (XM_012952601.1 and XP_012808055.1, XM_012952608.2 and XP_012808062.1, XM_012952597.2 and XP_012808051.1, XM_012952613.2 and XP_012808067.1, and XM_002941009.4 and XP_002941055.2), and zebrafish BRM (NM_001044775.2 and NP_001038240.1).

Anti-BRM antibodies suitable for detecting BRM protein are well-known in the art and include, for example, antibody MABE89 (EMD Millipore, Billerica, MA), antibody TA351725 (OnGene Technologies, Rockville, MD), NBP1-90015, NBP1-80042, NB100-55308, NB100-55309, NB100-55307, and H00006595-M06 (antibodes from Novus Biologicals, Littleton, CO), ab15597, ab12165, ab58188, and ab200480 (antibodies from AbCam, Cambridge, MA), Cat #: 11966 and 6889 (antibodies from Cell Signaling, Danvers, MA), etc. In addition, reagents are well-known for detecting BRM expression. Moreover, multiple siRNA, shRNA, CRISPR constructs for reducing BRM Expression can be found in the commercial product lists of the above-referenced companies. For example, BRM RNAi product H00006595-R02 (Novus Biologicals), CRISPER gRNA products from GenScript, Piscataway, NJ, and other inhibitory RNA products from Origene, ViGene Biosciences (Rockville, MD), and Santa Cruz. It is to be noted that the term can further be used to refer to any combination of features described herein regarding BRM molecules. For example, any combination of sequence composition, percentage identify, sequence length, domain structure, functional activity, etc. can be used to describe an BRM molecule of the present invention.

The term "BAF200" or "ARID2" refers to AT-rich interactive domain-containing protein 2, a subunit of the SWI/SNF complex, which can be found in PBAF but not BAF complexes. It facilitates ligand-dependent transcriptional activation by nuclear receptors. The ARID2 gene, located on chromosome 12q in humans, consists of 21 exons; orthologs are known from mouse, rat, cattle, chicken, and mosquito (Zhao et al. (2011) *Oncotarget* 2:886-891). A conditional knockout mouse line, called $Arid2^{tm1a(EUCOMM)Wtsi}$ was generated as part of the International Knockout Mouse Consortium program, a high-throughput mutagenesis project to generate and distribute animal models of disease (Skames et al. (2011) *Nature* 474:337-342). Human ARID2 protein has 1835 amino acids and a molecular mass of 197391 Da. The ARID2 protein contains two conserved C-terminal C2H2 zinc fingers motifs, a region rich in the amino acid residues proline and glutamine, a RFX (regulatory factor X)-type winged-helix DNA-binding domain (e.g., amino acids 521-601 of SEQ ID NO:8), and a conserved N-terminal AT-rich DNA interaction domain (e.g., amino acids 19-101 of SEQ ID NO:8; Zhao et al. (2011), supra). Mutation studies have revealed ARID2 to be a significant tumor suppressor in many cancer subtypes. ARID2 mutations are prevalent in hepatocellular carcinoma (Li et al. (2011) *Nature Genetics.* 43:828-829) and melanoma (Hodis et al. (2012) *Cell* 150:251-263; Krauthammer et al. (2012) *Nature Genetics.* 44:1006-1014). Mutations are present in a smaller but significant fraction in a wide range of other tumors (Shain and Pollack (2013), supra). ARID2 mutations are enriched in hepatitis C virus-associated hepatocellular carcinoma in the U.S. and European patient populations compared with the overall mutation frequency (Zhao et al. (2011), supra). The known binding partners for ARID2 include, e.g., Serum Response Factor (SRF) and SRF cofactors MYOCD, NKX2-5 and SRFBP1.

The term "BAF200" or "ARID2" is intended to include fragments, variants (e.g., allelic variants), and derivatives thereof. ReRepresentative human ARID2 cDNA and human ARID2 protein sequences are well-known in the art and are publicly available from the National Center for Biotechnology Information (NCBI). For example, two different human ARID2 isoforms are known. Human ARID2 isoform A (NP_689854.2) is encodable by the transcript variant 1 (NM_152641.3), which is the longer transcript. Human ARID2 isoform B (NP_001334768.1) is encodable by the transcript variant 2 (NM_001347839.1), which differs in the 3' UTR and 3' coding region compared to isoform A. The encoded isoform B has a shorter C-terminus compared to isoform A. Nucleic acid and polypeptide sequences of ARID2 orthologs in organisms other than humans are well known and include, for example, chimpanzee ARID2

(XM_016923581.1 and XP_016779070.1, and XM_016923580.1 and XP_016779069.1), Rhesus monkey ARID2 (XM_015151522.1 and XP_015007008.1), dog ARID2 (XM_003433553.2 and XP_003433601.2; and XM_014108583.1 and XP_013964058.1), cattle ARID2 (XM_002687323.5 and XP_002687369.1; and XM_015463314.1 and XP_015318800.1), mouse ARID2 (NM_175251.4 and NP_780460.3), rat ARID2 (XM_345867.8 and XP_345868.4; and XM_008776620.1 and XP_008774842.1), chicken ARID2 (XM_004937552.2 and XP_004937609.1, XM_004937551.2 and XP_004937608.1, XM_004937554.2 and XP_004937611.1, and XM_416046.5 and XP_416046.2), tropical clawed frog ARID2 (XM_002932805.4 and XP_002932851.1, XM_018092278.1 and XP_017947767.1, and XM_018092279.1 and XP_017947768.1), and zebrafish ARID2 (NM_001077763.1 and NP_001071231.1, and XM_005164457.3 and XP_005164514.1). ReRepresentative sequences of ARID2 orthologs are presented below in Table 1.

Anti-ARID2 antibodies suitable for detecting ARID2 protein are well-known in the art and include, for example, antibodies ABE316 and 04-080 (EMD Millipore, Billerica, MA), antibodies NBP1-26615, NBP2-43567, and NBP1-26614 (Novus Biologicals, Littleton, CO), antibodies ab51019, ab166850, ab113283, and ab56082 (AbCam, Cambridge, MA), antibodies Cat #: PA5-35857 and PA5-51258 (ThermoFisher Scinetific, Waltham, MA), antibodies GTX129444, GTX129443, and GTX632011 (GeneTex, Irvine, CA), ARID2 (H-182) Antibody, ARID2 (H-182) X Antibody, ARID2 (5-13) Antibody, ARID2 (5-13) X Antibody, ARID2 (E-3) Antibody, and ARID2 (E-3) X Antibody (Santa Cruz Biotechnology), etc. In addition, reagents are well-known for detecting ARID2 expression. Multiple clinical tests of PBRM1 are available in NIH Genetic Testing Registry (GTR®) (e.g., GTR Test ID: GTR000541481.2, offered by Fulgent Clinical Diagnostics Lab (Temple City, CA)). Moreover, multiple siRNA, shRNA, CRISPR constructs for reducing ARID2 expression can be found in the commercial product lists of the above-referenced companies, such as siRNA product #SR316272, shRNA products #TR306601, TR505226, TG306601, SR420583, and CRISPER products #KN212320 and KN30154 from Origene Technologies (Rockville, MD), RNAi product H00196528-R01 (Novus Biologicals), CRISPER gRNA products from GenScript (Cat. #KN301549 and KN212320, Piscataway, NJ) and from Santa Cruz (sc-401863), and RNAi products from Santa Cruz (Cat #sc-96225 and sc-77400). It is to be noted that the term can further be used to refer to any combination of features described herein regarding ARID2 molecules. For example, any combination of sequence composition, percentage identify, sequence length, domain structure, functional activity, etc. can be used to describe an ARID2 molecule of the present invention.

The term "loss-of-function mutation" for BAF200/ARID2 refers to any mutation in a ARID2-related nucleic acid or protein that results in reduced or eliminated ARID2 protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID2. Such mutations reduce or eliminate ARID2 protein amounts and/or function by eliminating proper coding sequences required for proper ARID2 protein translation and/or coding for ARID2 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated ARID2 protein amounts and/or function is described in the Tables and the Examples.

The term "BRD7" refers to Bromodomain-containing protein 7, a subunit of the SWI/SNF complex, which can be found in PBAF but not BAF complexes. BRD7 is a transcriptional corepressor that binds to target promoters (e.g., the ESR1 promoter) and down-regulates the expression of target genes, leading to increased histone H3 acetylation at Lys-9 (H3K9ac). BRD7 can recruit other proteins such as BRCA1 and POU2F1 to, e.g., the ESR1 promoter for its function. BRD7 activates the Wnt signaling pathway in a DVL1-dependent manner by negatively regulating the GSK3B phosphotransferase activity, while BRD7 induces dephosphorylation of GSK3B at Tyr-216. BRD7 is also a coactivator for TP53-mediated activation of gene transcription and is required for TP53-mediated cell-cycle arrest in response to oncogene activation. BRD7 promotes acetylation of TP53 at Lys-382, and thereby promotes efficient recruitment of TP53 to target promoters. BRD7 also inhibits cell cycle progression from G1 to S phase. For studies on BRD7 functions, see Zhou et al. (2006) *J. Cell. Biochem.* 98:920-930; Harte et al. (2010) *Cancer Res.* 70:2538-2547; Drost et al. (2010) *Nat. Cell Biol.* 12:380-389. The known binding partners for BRD7 also include, e.g., Tripartite Motif Containing 24 (TRIM24), Protein Tyrosine Phosphatase, Non-Receptor Type 13 (PTPN13), Dishevelled Segment Polarity Protein 1 (DVL1), interferon regulatory factor 2 (IRF2) (Staal et al. (2000) *J. Cell. Physiol.* US 185:269-279) and heterogeneous nuclear ribonucleoprotein U-like protein 1 (HNRPUL1) (Kzhyshkowska et al. (2003) *Biochem. J. England.* 371:385-393). Human BRD7 protein has 651 amino acids and a molecular mass of 74139 Da, with a N-terminal nuclear localization signal (e.g., amino acids 65-96 of SEQ ID NO:14), a Bromo-BRD7-like domain (e.g., amino acids 135-232 of SEQ ID NO:14), and a DUF3512 domain (e.g., amino acids 287-533 of SEQ ID NO:14).

The term "BRD7" is intended to include fragments, variants (e.g., allelic variants), and derivatives thereof. ReRepresentative human BRD7 cDNA and human BRD7 protein sequences are well-known in the art and are publicly available from the National Center for Biotechnology Information (NCBI). For example, two different human BRD7 isoforms are known. Human BRD7 isoform A (NP_001167455.1) is encodable by the transcript variant 1 (NM_001173984.2), which is the longer transcript. Human BRD7 isoform B (NP_037395.2) is encodable by the transcript variant 2 (NM_013263.4), which uses an alternate in-frame splice site in the 3' coding region, compared to variant 1. The resulting isoform B lacks one internal residue, compared to isoform A. Nucleic acid and polypeptide sequences of BRD7 orthologs in organisms other than humans are well known and include, for example, chimpanzee BRD7 (XM_009430766.2 and XP_009429041.1, XM_016929816.1 and XP_016785305.1, XM_016929815.1 and XP_016785304.1, and XM_003315094.4 and XP_003315142.1), Rhesus monkey BRD7 (XM_015126104.1 and XP_014981590.1, XM_015126103.1 and XP_014981589.1, XM_001083389.3 and XP_001083389.2, and XM_015126105.1 and XP_014981591.1), dog BRD7 (XM_014106954.1 and XP_013962429.1), cattle BRD7 (NM_001103260.2 and NP_001096730.1), mouse BRD7 (NM_012047.2 and NP_036177.1), chicken BRD7 (NM_001005839.1 and NP_001005839.1), tropical clawed frog BRD7 (NM_001008007.1 and NP_001008008.1), and zebrafish BRD7 (NM_213366.2 and NP_998531.2). Representative sequences of BRD7 orthologs are presented below in Table 1.

Anti-BRD7 antibodies suitable for detecting BRD7 protein are well-known in the art and include, for example, antibody TA343710 (Origene), antibody NBP1-28727 (Novus Biologicals, Littleton, CO), antibodies ab56036, ab46553, ab202324, and ab114061 (AbCam, Cambridge, MA), antibodies Cat #: 15125 and 14910 (Cell Signaling), antibody GTX118755 (GeneTex, Irvine, CA), BRD7 (P-13) Antibody, BRD7 (T-12) Antibody, BRD7 (H-77) Antibody, BRD7 (H-2) Antibody, and BRD7 (B-8) Antibody (Santa Cruz Biotechnology), etc. In addition, reagents are well-known for detecting BRD7 expression. A clinical test of BRD7 is available in NIH Genetic Testing Registry (GTR®) with GTR Test ID: GTR000540400.2, offered by Fulgent Clinical Diagnostics Lab (Temple City, CA)). Moreover, multiple siRNA, shRNA, CRISPR constructs for reducing BRD7 expression can be found in the commercial product lists of the above-referenced companies, such as shRNA product #TR100001 and CRISPER products #KN302255 and KN208734 from Origene Technologies (Rockville, MD), RNAi product H00029117-R01 (Novus Biologicals), and small molecule inhibitors BI 9564 and TP472 (Tocris Bioscience, UK). It is to be noted that the term can further be used to refer to any combination of features described herein regarding BRD7 molecules. For example, any combination of sequence composition, percentage identify, sequence length, domain structure, functional activity, etc. can be used to describe an BRD7 molecule of the present invention.

The term "loss-of-function mutation" for BRD7 refers to any mutation in a BRD7-related nucleic acid or protein that results in reduced or eliminated BRD7 protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of BRD7. Such mutations reduce or eliminate BRD7 protein amounts and/or function by eliminating proper coding sequences required for proper BRD7 protein translation and/or coding for BRD7 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated BRD7 protein amounts and/or function is described in the Tables and the Examples.

The term "BAF45A" or "PHF10" refers to PHD finger protein 10, a subunit of the PBAF complex having two zinc finger domains at its C-terminus. PHF10 belongs to the neural progenitors-specific chromatin remodeling complex (npBAF complex) and is required for the proliferation of neural progenitors. During neural development a switch from a stem/progenitor to a post-mitotic chromatin remodeling mechanism occurs as neurons exit the cell cycle and become committed to their adult state. The transition from proliferating neural stem/progenitor cells to post-mitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. PHF10 gene encodes at least two types of evolutionarily conserved, ubiquitously expressed isoforms that are incorporated into the PBAF complex in a mutually exclusive manner. One isoform contains C-terminal tandem PHD fingers, which in the other isoform are replaced by the consensus sequence for phosphorylation-dependent SUMO 1 conjugation (PDSM) (Brechalov et al. (2014) *Cell Cycle* 13:1970-1979). PBAF complexes containing different PHF10 isoforms can bind to the promoters of the same genes but produce different effects on the recruitment of Pol II to the promoter and on the level of gene transcription. PHF10 is a transcriptional repressor of caspase 3 and impares the programmed cell death pathway in human gastric cancer at the transcriptional level (Wei et al. (2010) *Mol Cancer Ther.* 9:1764-1774). Knockdown of PHF10 expression in gastric cancer cells led to significant induction of caspase-3 expression at both the RNA and protein levels and thus induced alteration of caspase-3 substrates in a time-dependent manner (Wei et al. (2010), supra). Results from luciferase assays by the same group indicated that PHF10 acted as a transcriptional repressor when the two PHD domains contained in PHF10 were intact. Human PHF10 protein has 498 amino acids and a molecular mass of 56051 Da, with two domains essential to induce neural progenitor proliferation (e.g., amino acids 89-185 and 292-334 of SEQ ID NO:20) and two PHD finger domains (e.g., amino acids 379-433 and 435-478 of SEQ ID NO:20). By similarity, PHF 10 binds to ACTL6A/BAF53A, SMARCA2/BRM/BAF190B, SMARCA4/BRG1/BAF190A and PBRM1/BAF180.

The term "BAF45A" or "PHF10" is intended to include fragments, variants (e.g., allelic variants), and derivatives thereof. ReRepresentative human PHF10 cDNA and human PHF10 protein sequences are well-known in the art and are publicly available from the National Center for Biotechnology Information (NCBI). For example, two different human PHF10 isoforms are known. Human PHF10 isoform A (NP_060758.2) is encodable by the transcript variant 1 (NM_018288.3), which is the longer transcript. Human PHF10 isoform B (NP_579866.2) is encodable by the transcript variant 2 (NM_133325.2), which uses an alternate splice junction which results in six fewer nt when compared to variant 1. The isoform B lacks 2 internal amino acids compared to isoform A. Nucleic acid and polypeptide sequences of PHF10 orthologs in organisms other than humans are well known and include, for example, chimpanzee PHF10 (XM_016956680.1 and XP 016812169.1, XM_016956679.1 and XP_016812168.1, and XM_016956681.1 and XP_016812170.1), Rhesus monkey PHF10 (XM_015137735.1 and XP_014993221.1, and XM_015137734.1 and XP_014993220.1), dog PHF10

(XM_005627727.2 and XP_005627784.1, XM_005627726.2 and XP_005627783.1, XM_532272.5 and XP_532272.4, XM_014118230.1 and XP_013973705.1, and XM_014118231.1 and XP_013973706.1), cattle PHF10 (NM_001038052.1 and NP_001033141.1), mouse PHF10 (NM_024250.4 and NP_077212.3), rat PHF10 (NM_001024747.2 and NP_001019918.2), chicken PHF10 (XM_015284374.1 and XP_015139860.1), tropical clawed frog PHF10 (NM_001030472.1 and NP_001025643.1), zebrafish PHF10 (NM_200655.3 and NP_956949.3), and C. elegans PHF10 (NM_001047648.2 and NP_001041113.1, NM_001047647.2 and NP_001041112.1, and NM_001313168.1 and NP_001300097.1). Representative sequences of PHF10 orthologs are presented below in Table 1.

Anti-PHF10 antibodies suitable for detecting PHF10 protein are well-known in the art and include, for example, antibody TA346797 (Origene), antibodies NBP1-52879, NBP2-19795, NBP2-33759, and H00055274-B01P (Novus Biologicals, Littleton, CO), antibodies ab154637, ab80939, and ab68114 (AbCam, Cambridge, MA), antibody Cat #PA5-30678 (ThermoFisher Scientific), antibody Cat #26-352 (ProSci, Poway, CA), etc. In addition, reagents well-known for detecting PHF10 expression. A clinical test of PHF10 for hereditary disease is available with the test ID no. GTR000536577 in NIH Genetic Testing Registry (GTR*), offered by Fulgent Clinical Diagnostics Lab (Temple City, CA). Moreover, multiple siRNA, shRNA, CRISPR constructs for reducing PHF10 expression can be found in the commercial product lists of the above-referenced companies, such as siRNA product #sc-95343 and sc-152206 and CRISPER products #sc-410593 from Santa Cruz Biotechnology, RNAi products H00055274-R01 and H00055274-R02 (Novus Biologicals), and multiple CRISPER products from GenScript (Piscataway, NJ). Human PHF10 knockout cell (from HAP1 cell line) is also available from Horizon Discovery (Cat #HZGHC002778c011, UK). It is to be noted that the term can further be used to refer to any combination of features described herein regarding PHF10 molecules. For example, any combination of sequence composition, percentage identify, sequence length, domain structure, functional activity, etc. can be used to describe an PHF10 molecule of the present invention.

The term "loss-of-function mutation" for BAF45A/PHF10 refers to any mutation in a PHF10-related nucleic acid or protein that results in reduced or eliminated PHF10 protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of PHF10. Such mutations reduce or eliminate PHF10 protein amounts and/or function by eliminating proper coding sequences required for proper PHF10 protein translation and/or coding for PHF10 proteins that are non-functional or have reduced function (e.g., deletion of enzymatic and/or structural domains, reduction in protein stability, alteration of subcellular localization, and the like). Such mutations are well-known in the art. In addition, a reRepresentative list describing a wide variety of structural mutations correlated with the functional result of reduced or eliminated PHF10 protein amounts and/or function is described in the Tables and the Examples.

The term "PBRM1" or "BAF180" refers to protein Polybromo-1, which is a subunit of ATP-dependent chromatin-remodeling complexes. PBRM1 functions in the regulation of gene expression as a constituent of the evolutionary-conserved SWI/SNF chromatin remodelling complexes (Euskirchen et al. (2012) J Biol. Chem. 287:30897-30905). Beside BRD7 and BAF200, PBRM1 is one of the unique components of the SWI/SNF-B complex, also known as polybromo/BRG1-associated factors (or PBAF), absent in the SWI/SNF-A (BAF) complex (Xue et al. (2000) Proc Natl Acad Sci USA. 97:13015-13020; Brownlee et al. (2012) Biochem Soc Trans. 40:364-369). On that account, and because it contains bromodomains known to mediate binding to acetylated histones, PBRM1 has been postulated to target PBAF complex to specific chromatin sites, therefore providing the functional selectivity for the complex (Xue et al. (2000), supra; Lemon et al. (2001) Nature 414:924-928; Brownlee et al. (2012), supra). Although direct evidence for PBRM1 involvement is lacking, SWI/SNF complexes have also been shown to play a role in DNA damage response (Park et al. (2006) EMBO J. 25:3986-3997). In vivo studies have shown that PBRM1 deletion leads to embryonic lethality in mice, where PBRM1 is required for mammalian cardiac chamber maturation and coronary vessel formation (Wang et al. (2004) Genes Dev. 18:3106-3116; Huang et al. (2008) Dev Biol. 319:258-266). PBRM1 mutations are most predominant in renal cell carcinomas (RCCs) and have been detected in over 40% of cases, placing PBRM1 second (after VHL) on the list of most frequently mutated genes in this cancer (Varela et al. (2011) Nature 469:539-542; Hakimi et al. (2013) Eur Urol. 63:848-854; Pena-Llopis et al. (2012) Nat Genet. 44:751-759; Pawlowski et al. (2013) Int J Cancer. 132:E11-E17). PBRM1 mutations have also been found in a smaller group of breast and pancreatic cancers (Xia et al. (2008) Cancer Res. 68:1667-1674; Shain et al. (2012) Proc Natl Acad Sci USA. 109:E252-E259; Numata et al. (2013) Int J Oncol. 42:403-410). PBRM1 mutations are more common in patients with advance stages (Hakimi et al. (2013), supra) and loss of PBRM1 protein expression has been associated with advanced tumour stage, low differentiation grade and worse patient outcome (Pawlowski et al. (2013), supra). In another study, no correlation between PBRM1 status and tumour grade was found (Pena-Llopis et al. (2012), supra). Although PBRM1-mutant tumours are associated with better prognosis than BAP1-mutant tumours, tumours mutated for both PBRM1 and BAP1 exhibit the greatest aggressiveness (Kapur et al. (2013) Lancet Oncol. 14:159-167). PBRM1 is ubiquitously expressed during mouse embryonic development (Wang et al. (2004), supra) and has been detected in various human tissues including pancreas, kidney, skeletal muscle, liver, lung, placenta, brain, heart, intestine, ovaries, testis, prostate, thymus and spleen (Xue et al. (2000), supra; Horikawa and Barrett (2002) DNA Seq. 13:211-215).

PBRM1 protein localises to the nucleus of cells (Nicolas and Goodwin (1996) Gene 175:233-240). As a component of the PBAF chromatin-remodelling complex, it associates with chromatin (Thompson (2009) Biochimie. 91:309-319), and has been reported to confer the localisation of PBAF complex to the kinetochores of mitotic chromosomes (Xue et al. (2000), supra). Human PBRM1 gene encodes a 1582 amino acid protein, also referred to as BAF180. Six bromodomains (BD1-6), known to recognize acetylated lysine residues and frequently found in chromatin-associated proteins, constitute the N-terminal half of PBRM1 (e.g., six BD domains at amino acid residue no. 44-156, 182-284, 383-484, 519-622, 658-762, and 775-882 of SEQ ID NO:2). The C-terminal half of PBRM1 contains two bromo-adjacent homology (BAH) domains (BAH1 and BAH2, e.g., at amino acid residue no. 957-1049 and 1130-1248 of SE ID NO:2), present in some proteins involved in transcription regulation. High mobility group (HMG) domain is located close to the C-terminus of PBRM1 (e.g., amino acid residue no. 1328-1377 of SEQ ID NO:2). HMG domains are found in a number of factors regulating DNA-dependent processes where HMG domains often mediate interactions with DNA.

The term "PBRM1" is intended to include fragments, variants (e.g., allelic variants), and derivatives thereof. ReRepresentative human PBRM1 cDNA and human PBRM1 protein sequences are well-known in the art and are publicly available from the National Center for Biotechnology Information (NCBI). For example, two different human PBRM1 isoforms are known. Human PBRM1 transcript variant 2 (NM_181042.4) represents the longest transcript. Human PBRM1 transcript variant 1 (NM_018313.4, having a CDS from the 115-4863 nucleotide residue of SEQ ID NO:1) differs in the 5' UTR and uses an alternate exon and splice site in the 3' coding region, thus encoding a distinct protein sequence (NP_060783.3, as SEQ ID NO:2) of the same length as the isoform (NP_851385.1) encoded by variant 2. Nucleic acid and polypeptide sequences of PBRM1 orthologs in organisms other than humans are well known and include, for example, chimpanzee PBRM1 (XM_009445611.2 and XP_009443886.1, XM_009445608.2 and XP 009443883.1, XM_009445602.2 and XP_009443877.1, XM 016941258.1 and XP 016796747.1, XM_016941256.1 and XP 016796745.1, XM_016941249.1 and XP 016796738.1, XM_016941260.1 and XP_016796749.1, XM_016941253.1 and XP 016796742.1, XM_016941250.1 and XP_016796739.1, XM_016941261.1 and XP 016796750.1, XM_009445605.2 and XP_009443880.1, XM 016941252.1 and XP 016796741.1, XM_009445603.2 and XP 009443878.1, XM_016941263.1 and XP 016796752.1, XM_016941262.1 and XP_016796751.1, XM_009445604.2 and XP 009443879.1, XM_016941251.1 and XP_016796740.1, XM_016941257.1 and XP 016796746.1, XM_016941255.1 and XP_016796744.1, XM 016941254.1 and XP 016796743.1, XM 016941265.1 and XP 016796754.1, XM_016941264.1 and XP 016796753.1, XM_016941248.1 and XP_016796737.1, XM_009445617.2 and XP 009443892.1, XM_009445616.2 and XP_009443891.1, XM_009445619.2 and XP_009443894.1 XM_009445615.2 and XP_009443890.1, XM_009445618.2 and XP_009443893.1, and XM_016941266.1 and XP_016796755.1), rhesus monkey PBRM1 (XM_015130736.1 and XP_014986222.1, XM_015130739.1 and XP_014986225.1, XM_015130737.1 and XP_014986223.1, XM_015130740.1 and XP_014986226.1, XM_015130727.1 and XP_014986213.1, XM_015130726.1 and XP_014986212.1, XM_015130728.1 and XP_014986214.1, XM_015130743.1 and XP_014986229.1, XM_015130731.1 and XP_014986217.1, XM_015130745.1 and XP_014986231.1, XM_015130741.1 and XP_014986227.1, XM_015130720.1 and XP_014986220.1, XM_015130744.1 and XP_014986230.1, XM_015130748.1 and XP_014986234.1, XM_015130746.1 and XP_014986232.1, XM_015130742.1 and XP_014986228.1, XM_015130747.1 and XP_014986233.1, XM_015130730.1 and XP_014986216.1, XM_015130732.1 and XP_014986218.1, XM_015130733.1 and XP_014986219.1, XM_015130735.1 and XP_014986221.1, XM_015130738.1 and XP_014986224.1, and XM_015130725.1 and XP_014986211.1), dog PBRM1 (XM_005632441.2 and XP_005632498.1, XM_014121868.1 and XP_013977343.1, XM_005632451.2 and XP 005632508.1, XM_014121867.1 and XP_013977342.1, XM_005632440.2 and XP 005632497.1, XM_005632446.2 and XP_005632503.1, XM_533797.5 and XP 533797.4, XM_005632442.2 and XP_005632499.1, XM 005632439.2 and XP 005632496.1, XM_014121869.1 and XP 013977344.1, XM_005632448.1 and XP 005632505.1, XM_005632449.1 and XP_005632506.1, XM_005632452.1 and XP 005632509.1, XM_005632445.1 and XP_005632502.1, XM_005632450.1 and XP 005632507.1, XM_005632453.1 and XP_005632510.1, XM_014121870.1 and XP 013977345.1, XM_005632443.1 and XP_005632500.1, XM_005632444.1 and XP_005632501.1, and XM_005632447.2 and XP_005632504.1), cow PBRM1 (XM_005222983.3 and XP_005223040.1, XM_005222979.3 and XP_005223036.1, XM_015459550.1 and XP_015315036.1, XM_015459551.1 and XP_015315037.1, XM_015459548.1 and XP_015315034.1, XM_010817826.1 and XP_010816128.1, XM_010817829.1 and XP_010816131.1, XM_010817830.1 and XP_010816132.1, XM_010817823.1 and XP_010816125.1, XM_010817824.2 and XP_010816126.1, XM_010817819.2 and XP_010816121.1, XM_010817827.2 and XP_010816129.1, XM_010817828.2 and XP_010816130.1, XM_010817817.2 and XP_010816119.1, and XM_010817818.2 and XP_010816120.1), mouse PBRM1 (NM_001081251.1 and NP_001074720.1), chicken PBRM1 (NM_205165.1 and NP_990496.1), tropical clawed frog PBRM1 (XM_018090224.1 and XP_017945713.1), zebrafish PBRM1 (XM_009305786.2 and XP_009304061.1, XM_009305785.2 and XP_009304060.1, and XM_009305787.2 and XP_009304062.1), fruit fly PBRM1 (NM_143031.2 and NP_651288.1), and worm PBRM1 (NM_001025837.3 and NP_001021008.1 and .NM_001025838.2 and NP_001021009.1). ReRepresentative sequences of PBRM1 orthologs are presented below in Table 1.

Anti-PBRM1 antibodies suitable for detecting PBRM1 protein are well-known in the art and include, for example, ABE70 (rabbit polyclonal antibody, EMD Millipore, Billerica, MA), TA345237 and TA345238 (rabbit polyclonal antibodies, OriGene Technologies, Rockville, MD), NBP2-30673 (mouse monoclonal) and other polyclonal antibodies (Novus Biologicals, Littleton, CO), ab196022 (rabiit mAb, AbCam, Cambridge, MA), PAH437Hu01 and PAH437Hu02 (rabbit polyclonal antibodies, Cloud-Clone Corp., Houston, TX), GTX100781 (GeneTex, Irvine, CA), 25-498 (ProSci, Poway, CA), sc-367222 (Santa Cruz Biotechnology, Dallas, TX), etc. In addition, reagents are well-known for detecting PBRM1 expression (see, for example, PBRM1 Hu-Cy3 or Hu-Cy5 SmartFlare™ RNA Detection Probe (EMD Millipore). Multiple clinical tests of PBRM1 are available in NIH Genetic Testing Registry (GTR®) (e.g., GTR Test ID: GTR000537378.2 which is offered by Fulgent Clinical Diagnostics Lab (Temple City, CA)). Moreover, multiple siRAN, shRNA, CRISPR constructs for reducing PBRM1 expression can be found in the commercial product lists of the above-referenced companies. Ribavirin and PFI 3 are known PBRM1 inhibitors. It is to be noted that the term can further be used to refer to any combination of features described herein regarding PBRM1 molecules. For example, any combination of sequence composition, percentage identify, sequence length, domain structure, functional activity, etc. can be used to describe an PBRM1 molecule of the present invention.

The term "PBRM1 loss-of-function mutation" refers to any mutation in a PBRM1-related nucleic acid or protein that results in reduced or eliminated PBRM1 protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of PBRM1. Such mutations reduce or eliminate PBRM1 protein amounts and/or function by eliminating proper coding sequences required for proper PBRM1 protein translation and/or coding for PBRM1 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated PBRM1 protein amounts and/or function is described in the Tables and the Examples.

The term "BAF250A" or "ARID1A" refers to AT-rich interactive domain-containing protein 1A, a subunit of the SWI/SNF complex, which can be find in BAF but not PBAF complex. In humans there are two BAF250 isoforms, BAF250A/ARID1A and BAF250B/ARID1B. They are thought to be E3 ubiquitin ligases that target histone H2B (Li et al. (2010) *Mol. Cell. Biol.* 30:1673-1688). ARID1A is highly expressed in the spleen, thymus, prostate, testes, ovaries, small intestine, colon and peripheral leukocytes. ARID1A is involved in transcriptional activation and repression of select genes by chromatin remodeling. It is also involved in vitamin D-coupled transcription regulation by associating with the WINAC complex, a chromatin-remodeling complex recruited by vitamin D receptor. ARID1A belongs to the neural progenitors-specific chromatin remodeling (npBAF) and the neuron-specific chromatin remodeling (nBAF) complexes, which are involved in switching developing neurons from stem/progenitors to post-mitotic chromatin remodeling as they exit the cell cycle and become committed to their adult state. ARID1A also plays key roles in maintaining embryonic stem cell pluripotency and in cardiac development and function (Lei et al. (2012) *J Biol. Chem.* 287:24255-24262; Gao et al. (2008) *Proc. Natl. Acad. Sci. U.S.A.* 105:6656-6661). Loss of BAF250a expression was seen in 42% of the ovarian clear cell carcinoma samples and 21% of the endometrioid carcinoma samples, compared with just 1% of the high-grade serous carcinoma samples. ARID1A deficiency also impairs the DNA damage checkpoint and sensitizes cells to PARP inhibitors (Shen et al. (2015) *Cancer Discov.* 5:752-767). Human ARID1A protein has 2285 amino acids and a molecular mass of 242045 Da, with at least a DNA-binding domain that can specifically bind an AT-rich DNA sequence, recognized by a SWI/SNF complex at the beta-globin locus, and a C-terminus domain for glucocorticoid receptor-dependent transcriptional activation. ARID1A has been shown to interact with proteins such as SMARCB1/BAF47 (Kato et al. (2002) *J. Biol. Chem.* 277:5498-505; Wang et al. (1996) *EMBO J.* 15:5370-5382) and SMARCA4/BRG1 (Wang et al. (1996), supra; Zhao et al. (1998) *Cell* 95:625-636), etc.

The term "BAF250A" or "ARID1A" is intended to include fragments, variants (e.g., allelic variants), and derivatives thereof. Representative human BAF250A (ARID1A) cDNA and human BAF250A (ARID1A) protein sequences are well-known in the art and are publicly available from the National Center for Biotechnology Information (NCBI). For example, two different human ARID1A isoforms are known. Human ARID1A isoform A (NP_006006.3) is encodable by the transcript variant 1 (NM_006015.4), which is the longer transcript. Human ARID1A isoform B (NP_624361.1) is encodable by the transcript variant 2 (NM_139135.2), which lacks a segment in the coding region compared to variant 1. Isoform B thus lacks an internal segment, compared to isoform A. Nucleic acid and polypeptide sequences of ARID1A orthologs in organisms other than humans are well known and include, for example, chimpanzee ARID1A (XM_016956953.1 and XP_016812442.1, XM_016956958.1 and XP_016812447.1, and XM_009451423.2 and XP_009449698.2), Rhesus monkey ARID1A (XM_015132119.1 and XP_014987605.1, and XM_015132127.1 and XP_014987613.1), dog ARID1A (XM_847453.5 and XP_852546.3, XM_005617743.2 and XP_005617800.1, XM_005617742.2 and XP 005617799.1, XM_005617744.2 and XP_005617801.1, XM_005617746.2 and XP_005617803.1, and XM_005617745.2 and XP_005617802.1), cattle ARID1A (NM_001205785.1 and NP_001192714.1), mouse ARID1A (NM_001080819.1 and NP_001074288.1), rat ARID1A (NM_001106635.1 and NP_001100105.1), chicken ARID1A (XM_015297557.1 and XP_015153043.1, XM_015297556.1 and XP_015153042.1, and XM_417693.5 and XP_417693.5), tropical clawed frog ARID1A (XM_002934639.4 and XP_002934685.2), and zebrafish ARID1A (XM_009294131.2 and XP_009292406.1, and XM_009294132.2 and XP_009292407.1).

Anti-ARID1A antibodies suitable for detecting ARID1A protein are well-known in the art and include, for example, antibody Cat #04-080 (EMD Millipore, Billerica, MA), antibodies TA349170, TA350870, and TA350871 (OriGene Technologies, Rockville, MD), antibodies NBP1-88932, NB100-55334, NBP2-43566, NB100-55333, and H00008289-Q01 (Novus Biologicals, Littleton, CO), antibodies ab182560, ab182561, ab176395, and ab97995 (AbCam, Cambridge, MA), antibodies Cat #: 12354 and 12854 (Cell Signaling Technology, Danvers, MA), antibodies GTX129433, GTX129432, GTX632013, GTX12388, and GTX31619 (GeneTex, Irvine, CA), etc. In addition, reagents are well-known for detecting ARID1A expression. For example, multiple clinical tests for ARID1A are available at NIH Genetic Testing Registry (GTR©) (e.g., GTR Test ID: GTR000520952.1 for mental retardation, offered by Centogene AG, Germany). Moreover, multiple siRNA, shRNA, CRISPR constructs for reducing ARID1A Expression can be found in the commercial product lists of the above-referenced companies, such as RNAi products H00008289-R01, H00008289-R02, and H00008289-R03 (Novus Biologicals) and CRISPR products KN301547G1 and KN301547G2 (Origene). Other CRISPR products include sc-400469

(Santa Cruz Biotechnology) and those from GenScript (Piscataway, NJ). It is to be noted that the term can further be used to refer to any combination of features described herein regarding ARID1A molecules. For example, any combination of sequence composition, percentage identify, sequence length, domain structure, functional activity, etc. can be used to describe an ARID1A molecule of the present invention.

The term "loss-of-function mutation" for BAF250A/ARID1A refers to any mutation in an ARID1A-related nucleic acid or protein that results in reduced or eliminated ARID1A protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID1A. Such mutations reduce or eliminate ARID1A protein amounts and/or function by eliminating proper coding sequences required for proper ARID1A protein translation and/or coding for ARID1A proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated ARID1A protein amounts and/or function is described in the Tables and the Examples.

The term "BAF250B" or "ARID1B" refers to AT-rich interactive domain-containing protein 1B, a subunit of the SWI/SNF complex, which can be find in BAF but not PBAF complex. ARID1B and ARID1A are alternative and mutually exclusive ARID-subunits of the SWI/SNF complex. Germline mutations in ARID1B are associated with Coffin-Siris syndrome (Tsurusaki et al. (2012) *Nat. Genet.* 44:376-378; Santen et al. (2012) *Nat. Genet.* 44:379-380). Somatic mutations in ARID1B are associated with several cancer subtypes, suggesting that it is a tumor suppressor gene (Shai and Pollack (2013) *PLoS ONE* 8:e55119; Sausen et al. (2013) *Nat. Genet.* 45:12-17; Shain et al. (2012) *Proc. Natl. Acad. Sci. U.S.A.* 109:E252-E259; Fujimoto et al. (2012) *Nat. Genet.* 44:760-764). Human ARID1A protein has 2236 amino acids and a molecular mass of 236123 Da, with at least a DNA-binding domain that can specifically bind an AT-rich DNA sequence, recognized by a SWI/SNF complex at the beta-globin locus, and a C-terminus domain for glucocorticoid receptor-dependent transcriptional activation. ARID1B has been shown to interact with SMARCA4/BRG1 (Hurlstone et al. (2002) *Biochem. J.* 364:255-264; Inoue et al. (2002) *J Biol. Chem.* 277:41674-41685 and SMARCA2/BRM (Inoue et al. (2002), supra).

The term "BAF250B" or "ARID1B" is intended to include fragments, variants (e.g., allelic variants), and derivatives thereof. Representative human BAF250B (ARID1B) cDNA and human BAF250B (ARID1B) protein sequences are well-known in the art and are publicly available from the National Center for Biotechnology Information (NCBI). For example, three different human ARID1B isoforms are known. Human ARID1B isoform A (NP_059989.2) is encodable by the transcript variant 1 (NM_017519.2). Human ARID1B isoform B (NP_065783.3) is encodable by the transcript variant 2 (NM_020732.3). Human ARID1B isoform C (NP_001333742.1) is encodable by the transcript variant 3 (NM_001346813.1). Nucleic acid and polypeptide sequences of ARID1B orthologs in organisms other than humans are well known and include, for example, Rhesus monkey ARID1B (XM_015137088.1 and XP_014992574.1), dog ARID1B (XM_014112912.1 and XP_013968387.1), cattle ARID1B (XM_010808714.2 and XP_010807016.1, and XM_015464874.1 and XP_015320360.1), mouse ARID1B (NM_001085355.1 and NP_001078824.1), rat ARID1B (XM_017604567.1 and XP_017460056.1), chicken ARID1B (XM_015284235.1 and XP_015139721.1, XM_015284233.1 and XP 015139719.1, XM_015284238.1 and XP_015139724.1, XM 015284230.1 and XP 015139716.1, XM_015284234.1 and XP 015139720.1, XM_015284231.1 and XP 015139717.1, XM_015284232.1 and XP_015139718.1, XM_015284236.1 and XP_015139722.1, and XM_015284237.1 and XP_015139723.1), tropical clawed frog ARID1B (XM_004914629.3 and XP_004914686.1, XM_004914631.3 and XP 004914688.1, XM_004914630.3 and XP_004914687.1, XM_004914634.3 and XP_004914691.1, XM_002931507.4 and XP_002931553.2, XM_004914632.3 and XP_004914689.1, XM_004914635.3 and XP_004914692.1, XM_004914633.3 and XP_004914690.1, XM_004914636.3 and XP_004914693.1, and XM_004914637.3 and XP_004914694.1), and zebrafish ARID1B (XM_009294544.2 and XP_009292819.1, XM_009294545.2 and XP 009292820.1, XM_005160356.3 and XP_005160413.1, XM_005160355.3 and XP 005160412.1, XM_005160354.3 and XP_005160411.1, and XM_692987.8 and XP_698079.4).

Anti-ARID1B antibodies suitable for detecting ARID1B protein are well-known in the art and include, for example, antibody Cat #ABE316 (EMD Millipore, Billerica, MA), antibody TA315663 (OriGene Technologies, Rockville, MD), antibodies H00057492-M02, H00057492-MO1, NB100-57485, NBP1-89358, and NB100-57484 (Novus Biologicals, Littleton, CO), antibodies ab57461, ab69571, ab84461, and ab163568 (AbCam, Cambridge, MA), antibodies Cat #: PA5-38739, PA5-49852, and PA5-50918 (ThermoFisher Scientific, Danvers, MA), antibodies GTX130708, GTX60275, and GTX56037 (GeneTex, Irvine, CA), ARID1B (KMN1) Antibody and other antibodies (Santa Cruz Biotechnology), etc. In addition, reagents are well-known for detecting ARID1B expression. For example, multiple clinical tests for ARID1B are available at NIH Genetic Testing Registry (GTR®) (e.g., GTR Test ID: GTR000520953.1 for mental retardation, offered by Centogene AG, Germany). Moreover, multiple siRNA, shRNA, CRISPR constructs for reducing ARID1B Expression can be found in the commercial product lists of the above-referenced companies, such as RNAi products H00057492-R03, H00057492-R01, and H00057492-R02 (Novus Biologicals) and CRISPR products KN301548 and KN214830 (Origene). Other CRISPR products include sc-402365 (Santa Cruz Biotechnology) and those from GenScript (Piscataway, NJ). It is to be noted that the term can further be used to refer to any combination of features described herein regarding ARID1B molecules. For example, any combination of sequence composition, percentage identify, sequence length, domain structure, functional activity, etc. can be used to describe an ARID1B molecule of the present invention.

The term "loss-of-function mutation" for BAF250B/ARID1B refers to any mutation in an ARID1B-related nucleic acid or protein that results in reduced or eliminated ARID1B protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID1B. Such mutations reduce or eliminate ARID1B protein amounts and/or function by eliminating proper coding sequences required for proper ARID1B protein translation and/or coding for ARID1B proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated ARID1B protein amounts and/or function is described in the Tables and the Examples.

The term "CRB1" refers to Crumbs homolog 1, a protein similar to the *Drosophila* crumbs protein and localizes to the inner segment of mammalian photoreceptors. In *Drosophila* crumbs localizes to the stalk of the fly photoreceptor and may be a component of the molecular scaffold that controls proper development of polarity in the eye. CRB1 gene is involved in the Hippo signaling pathway. Mutations in this gene are associated with a severe form of retinitis pigmentosa, RP12, and with Leber congenital amaurosis. One study suggests that mutations in this gene are associated with keratoconus in patients that already have Leber's congenital amaurosis (McMahon et al. (2009) *Invest. Ophthalmol. Vis. Sci.* 50:3185-3187). CRB1 mutation is also related to lung squamous cell carcinoma (SQCC) (Li et al. (2015) *Sci. Rep.* 5:Article 14237) and retinal dystrophy (Li et al. (2014) *Int J Mol Med* 33:913-918). The human CRB1 protein has 1406 amino acids and a molecular mass of 154183 Da.

The term "CRB1" is intended to include fragments, variants (e.g., allelic variants), and derivatives thereof. Representative human CRB1 cDNA and human CRB1 protein sequences are well-known in the art and are publicly available from the National Center for Biotechnology Information (NCBI). For example, four different human CRB1 isoforms are known. Human CRB1 isoform A (NP_957705.1) is the longest isoform and is encodable by the transcript variant 1 (NM_201253.2). Human CRB1 isoform B (NP_001180569.1) is encodable by the transcript variant 2 (NM_001193640.1), which lacks two in-frame exons compared to variant 1. The resulting isoform B has the same N- and C-termini but is shorter compared to isoform A. Human CRB1 isoform C (NP_001244894.1) is encodable by the transcript variant 3 (NM_001257965.1), which contains three noncoding exons in place of the first exon and contains an alternate in-frame exon compared to variant 1. The resulting isoform C is shorter at the N-terminus and contains an alternate internal segment compared to isoform A. Human CRB1 isoform D (NP_001244895.1) is encodable by the transcript variant 4 (NM_001257966.1), which lacks an alternate in-frame segment of two coding exons and most of a third compared to variant 1. The resulting isoform D has the same N- and C-termini but lacks an alternate internal segment compared to isoform A. Nucleic acid and polypeptide sequences of CRB1 orthologs in organisms other than humans are well known and include, for example, chimpanzee CRB1 (XM_009440300.2 and XP_009438575.1, XM_009440289.2 and XP_009438564.1, XM_009440291.2 and XP_009438566.1, XM_016934908.1 and XP_016790397.1, XM_016934919.1 and XP_016790408.1, XM_016934927.1 and XP_016790416.1, XM_525009.5 and XP_525009.2, and XM_016934898.1 and XP_016790387.1), Rhesus monkey CRB1 (XM_015120817.1 and XP_014976303.1, XM_001110878.3 and XP_001110878.2, XM_001110912.3 and XP_001110912.2, XM_015120808.1 and XP_014976294.1, and XM_015120812.1 and XP_014976298.1), dog CRB1 (XM_014115056.1 and XP_013970531.1, XM_014115058.1 and XP_013970533.1, XM_005622293.2 and XP_005622350.1, and XM_014115057.1 and XP_013970532.1), cattle CRB1 (XM_010813559.2 and XP_010811861.1), mouse CRB1 (NM_133239.2 and NP_573502.2), rat CRB1 (NM_001107182.1 and NP_001100652.1), chicken CRB1 (XM_015290380.1 and XP_015145866.1, and XM_003641670.3 and XP_003641718.2), tropical clawed frog ARID1B (XM_018093205.1 and XP_017948694.1), and zebrafish CRB1 (NM 001044943.1 and NP_001038408.1).

Anti-CRB1 antibodies suitable for detecting CRB1 protein are well-known in the art and include, for example, antibody Cat #MABN1572 and ABE553 (EMD Millipore, Billerica, MA), antibody TA319859 (OnGene Technologies, Rockville, MD), antibody NBP2-41201 (Novus Biologicals, Littleton, CO), antibody ab156282 (AbCam, Cambridge, MA), antibody GTX32103 (GeneTex, Irvine, CA), CRB1 (H-14) Antibody (Santa Cruz Biotechnology), etc. In addition, reagents are well-known for detecting CRB1 expression. For example, multiple clinical tests for CRB1 are available at NIH Genetic Testing Registry (GTR®) (e.g., GTR Test ID: GTR000515886.2 for retinitis pigmentosa type 12, offered by Centogene AG, Germany). Moreover, multiple siRNA, shRNA, CRISPR constructs for reducing CRB1 Expression can be found in the commercial product lists of the above-referenced companies, such as RNAi products H00023418-R01 and H00023418-R02 (Novus Biologicals) and CRISPR products KN303799 and KN212347 (Origene). Other CRISPR products include sc-418097 (Santa Cruz Biotechnology) and those from GenScript (Piscataway, NJ). It is to be noted that the term can further be used to refer to any combination of features described herein regarding CRB1 molecules. For example, any combination of sequence composition, percentage identify, sequence length, domain structure, functional activity, etc. can be used to describe an CRB1 molecule of the present invention.

The term "loss-of-function mutation" for CRB1 refers to any mutation in a CRB1-related nucleic acid or protein that results in reduced or eliminated CRB1 protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of CRB1. Such mutations reduce or eliminate CRB1 protein amounts and/or function by eliminating proper coding sequences required for proper CRB1 protein translation and/or coding for CRB1 proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated CRB1 protein amounts and/or function is described in the Tables and the Examples.

The term "EGFR" refers to the epidermal growth factor receptor, a transmembrane glycoprotein that is a member of the ErbB family of receptors, a subfamily of four closely related receptor tyrosine kinases: EGFR (ErbB-1), HER2/c-neu (ErbB-2), Her 3 (ErbB-3) and Her 4 (ErbB-4). This protein is a receptor for members of the epidermal growth factor family. Binding of the protein to a ligand induces receptor homo- and/or heterodimerization and tyrosine autophosphorylation on key cytoplasmic residues. The activated EGFR then recruits adapter proteins like GRB2 which in turn activates complex downstream signaling cascades, leading to cell proliferation. Known ligands of EGFR include EGF, TGFA/TGF-alpha, amphiregulin, epigen/EPGN, BTC/betacellulin, epiregulin/EREG and HBEGF/heparin-binding EGF. While being activated, autophosphorylation of several tyrosine (Y) residues in the C-terminal domain of EGFR occurs. These include Y992, Y1045, Y1068, Y1148 and Y1173, as shown in the adjacent diagram (Downward et al. (1984) *Nature* 311:483-485). This autophosphorylation elicits downstream activation and signaling by several other proteins that associate with the phosphorylated tyrosines through their own phosphotyrosine-binding SH2 domains. These downstream signaling proteins initiate several signal transduction cascades, principally the MAPK, Akt and JNK pathways, leading to DNA synthesis and cell proliferation (Oda et al. (2005) *Mol. Sys. Biol.* 1:2005.0010). Such proteins modulate phenotypes such as cell migration, adhesion, and proliferation. Activation of the receptor is important for the innate immune response in human skin. The kinase domain of EGFR can also cross-phosphorylate tyrosine residues of other receptors it is aggregated with, and can itself be activated in that manner. EGFR activates at least 4 major downstream signaling cascades including the RAS-RAF-MEK-ERK, PI3 kinase-AKT, PLCgamma-PKC and STATs modules. EGFR may also activate the NF-kappa-B signaling cascade and other proteins like RGS16, by activating its GTPase activity, and probably coupling the EGF receptor signaling to the G protein-coupled receptor signaling. EGFR also phosphorylates MUC1 and increases its interaction with SRC and CTNNBT/beta-catenin. Mutations that lead to EGFR overexpression (i.e., upregulation) or overactivity have been associated with a number of cancers, including squamous-cell carcinoma of the lung (80% of cases), anal cancers (Walker et al. (2009) *Hum. Pathol.* 40:1517-1527), glioblastoma (50%) and epithelian tumors of the head and neck (80-100%) (Kumar et al. (2013) *Robbins basic pathology.* Philadelphia: Elsevier/Saunders. p. 179). These somatic mutations involving EGFR lead to its constant activation, which produces uncontrolled cell division. In glioblastoma a more or less specific mutation of EGFR, called EGFRvIII is often observed (Kuan et al. (2001) *Endocr. Relat. Cancer.* 8:83-96). Aberrant EGFR signaling has been implicated in psoriasis, eczema and atherosclerosis (Jost et al. (2000) *Eur. J Dermatol.* 10:505-510; Dreux et al. (2006) *Atherosclerosis* 186:38-53). However, its exact roles in these conditions are ill-defined. Human EGFR protein has 1210 amino acids and a molecular mass of 134277 Da, with at least a receptor L domain (amino acid no. 57-168 of SEQ ID NO:92), a Furin-like domain (amino acd no. 185-335 of SDEQ ID NO:92), another receptor L domain (amino acid no. 361-481 of SEQ ID NO:92), a growth factor receptor domain IV (amino acid no. 505-637 of SEQ ID NO: 92), a transmembrane region (amino acid no. 646-668 of SEQ ID NO:92), and a catalytic domain of the protein tyrosince kinase family (amino acid no. 704-1016 of SEQ ID NO:92). The structure and domains of human EGFR may be found at the World Wide Web address of www.uniprot.org/uniprot/P00533#structure and www.ebi.ac.uk/interpro/protein/P00533. EGFR has been shown to interact with proteins such as AR, ARF4, CAV1, CAV3, CBL, CBLB, CBLC, CD44, CDC25A, CRK, CTNNB1, DCN, EGF, GRB14, Grb2, JAK2, MUC1, NCK1, NCK2, PKC alpha, PLCG1, PLSCR1, PTPN1, PTPN11, PTPN6, PTPRK, SH2D3A, SH3KBP1, SHC1, SOS1, Src, STAT1, STAT3, STAT5A, UBC, and WAS.

The term "EGFR" is intended to include fragments, variants (e.g., allelic variants), and derivatives thereof. Representative human EGFR cDNA and human EGFR protein sequences are well-known in the art and are publicly available from the National Center for Biotechnology Information (NCBI). For example, nine different human EGFR isoforms are known. Human EGFR isoform A (NP_005219.2), the longest isoform, is encodable by the transcript variant 1 (NM_005228.4). Human EGFR isoform B (NP_958439.1) is encodable by the transcript variant 2 (NM_201282.1), which uses a different 3' terminal exon when compared to variant 1. The resulting isoform B has a shorter and distinct C-terminus. Human EGFR isoform C (also known as ErbB1-S, NP_958440.1) is encodable by the transcript variant 3 (NM_201283.1), which uses a different 3' terminal exon when compared to variant 1. The resulting isoform C has a shorter and distinct C-terminus. Only the extracellular domain is present in isoform C. Human EGFR isoform D (NP_958441.1) is encodable by the transcript variant 4 (NM_201284.1), which uses a different 3' terminal exon when compared to variant 1. The resulting isoform D has a shorter and distinct C-terminus. Only the extracellular domain is present in isoform D. Human EGFR isoform E (NP_001333826.1) is encodable by the transcript variant 5 (NM_001346897.1), which lacks an in-frame exon in the 5' coding region and its 3' terminal exon extends past a splice site that is used in variant 1. The encoded isoform E is shorter and has a distinct C-terminus compared to isoform A. Human EGFR isoform F (NP_001333827.1) is encodable by the transcript variant 6 (NM_001346898.1), which has a 3' terminal exon that extends past a splice site that is used in variant 1. The encoded isoform F has a shorter and distinct C-terminus compared to isoform A. Human EGFR isoform G (NP_001333828.1) is encodable by the transcript variant 7 (NM_001346899.1), which lacks an in-frame exon in the 5' coding region, compared to variant 1. Human EGFR isoform H (NP_001333829.1) is encodable by the transcript variant 8 (NM_001346900.1), which uses a novel 5' terminal exon compared to variant 1. The encoded isoform H has a shorter and distinct N-terminus compared to isoform A. Human EGFR isoform I (a.k.a. EGFRvIII, delta-EGFR, and de2-7EGFR; NP_001333870.1) is encodable by the transcript variant 9 (NM_001346941.1), which has an in-frame deletion of six exons in the 5' coding region, compared to variant 1. The encoded isoform I has a shorter extracellular domain compared to isoform A. This variant is considered to be tumorigenic and the encoded protein lacks normal ligand binding ability and is constitutively active. Nucleic acid and polypeptide sequences of EGFR orthologs in organisms other than humans are well known and include, for example, chimpanzee EGFR (XM_519102.6 and XP_519102.3, and XM_001156264.5 and XP_001156264.1), Rhesus monkey EGFR (XM_015133436.1 and XP_014988922.1, and XM_015133437.1 and XP_014988923.1), dog EGFR (XM_014120756.1 and XP_013976231.1), cattle EGFR (XM_002696890.4 and XP_002696936.2, and XM_592211.8 and XP_592211.4), mouse EGFR (NM_007912.4 and NP_031938.1, and NM_207655.2 and NP_997538.1), rat EGFR (NM_031507.1 and NP_113695.1, XM_008770416.2 and XP_008768638.1, XM_008770418.2 and XP_008768640.1, and XM_017599073.1 and XP_017454562.1), chicken EGFR (NM_205497.2 and NP_990828.2), tropical clawed frog EGFR (XM_002939914.4 and XP_002939960.2), and zebrafish EGFR (NM_194424.1 and NP_919405.1).

Anti-EGFR antibodies suitable for detecting EGFR protein are well-known in the art and include, for example, antibody Cat #06-847 (EMD Millipore, Billerica, MA), antibodies AM00029BT-N, AM00029PU-N, and others (OnGene Technologies, Rockville, MD), antibodies Cat #MAB8967, AF231, AF1095, and others (R&D Systems, Minneapolis, MN), antibodies NB120-10414, NBP1-84814, and others (Novus Biologicals, Littleton, CO), antibodies ab52894, ab40815, and others (AbCam, Cambridge, MA), antibodies Cat #: 4267, 2244, 48685, and others (Cell Signaling Technology, Danvers, MA), antibodies GTX121919, GTX628887, and others (GeneTex, Irvine, CA), etc. In addition, reagents are well-known for detecting EGFR expression. For example, multiple clinical tests for EGFR are available at NIH Genetic Testing Registry (GTR®) (e.g., GTR Test ID: GTR000514557.2 for EGFR mutation by Sanger Sequencing, offered by Cancer Genetics, Inc. (Rutherford, NJ), GTR Test ID: GTR000510455.1 for lung cancer, offered by Centogene AG, Germany, and other tests). Commercial ELISA kits for detecting EGFR are available, at least, from R&D Systems (Cat #DYC1095B-2, DYC1854-2, DEGFRO, DYC3570-2, etc.). Moreover, multiple siRNA, shRNA, CRISPR constructs for reducing EGFR Expression can be found in the commercial product lists of the above-referenced companies, such as RNAi products SC-29301, SC-44340, and others and CRISPR products sc-400015 (Santa Cruz Biotechnology). Other similar products include TG320326, TR320326, TG509941, and others shRNA products, as well as KN214877, KN204201, and others CRISPR products (Origene). Small molecule compounds are known to regulate EGFR expression, such as Cat. #A8197 and other inhibitors (ApexBio, Houston, TX), CAS 879127-07-8 and other inhibitors or activators (EMD Millipore). Known EGFR inhibitory drugs include, at least, Iressa™ (gefitinib), Tarceva™ (erlotinib), Tykerb™ (lapatinib), Erbitux™ (cetuximab), Vectibix™ (panitumumab), Caprelsa™ (vandetanib), Tagrisso™ (osimertinib), Portrazza™ (necitumumab), etc. It is to be noted that the term can further be used to refer to any combination of features described herein regarding EGFR molecules. For example, any combination of sequence composition, percentage identify, sequence length, domain structure, functional activity, etc. can be used to describe an EGFR molecule of the present invention.

The term "loss-of-function mutation" for EGFR refers to any mutation in an EGFR-related nucleic acid or protein that results in reduced or eliminated EGFR protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of EGFR. Such mutations reduce or eliminate EGFR protein amounts and/or function by eliminating proper coding sequences required for proper EGFR protein translation and/or coding for EGFR proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated EGFR protein amounts and/or function is described in the Tables and the Examples. In some embodiments, the term "hotspot mutation" for EGFR refers to a mutation that is commonly known to be mutated in EGFR associated with cancer. In some instances, such "hotspot mutations" can be those known to cause resistance to anti-EGFR therapies such as those described in Example 4.

Unless otherwise specified here within, the terms "antibody" and "antibodies" broadly encompass naturally-occurring forms of antibodies (e.g. IgG, IgA, IgM, IgE) and recombinant antibodies such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

The term "antibody" as used herein also includes an "antigen-binding portion" of an antibody (or simply "antibody portion"). The term "antigen-binding portion", as used herein, refers to one or more fragments of an antibody that retain the ability to specifically bind to an antigen (e.g., a biomarker polypeptide or fragment thereof). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CHI domains; (ii) a F(ab')$_2$ fragment, a bivalent fragment comprising two Fab fragments linked by a disulfide bridge at the hinge region; (iii) a Fd fragment consisting of the VH and CHI domains; (iv) a Fv fragment consisting of the VL and VH domains of a single arm of an antibody, (v) a dAb fragment (Ward et al. (1989) *Nature* 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent polypeptides (known as single chain Fv (scFv); see e.g., Bird et al. (1988) *Science* 242:423-426; and Huston et al. (1988) *Proc. Natl. Acad. Sci. USA* 85:5879-5883; and Osbourn et al. 1998, *Nature Biotechnology* 16: 778). Such single chain antibodies are also intended to be encompassed within the term "antigen-binding portion" of an antibody. Any VH and VL sequences of specific scFv can be linked to human immunoglobulin constant region cDNA or genomic sequences, in order to generate expression vectors encoding complete IgG polypeptides or other isotypes. VH and VL can also be used in the generation of Fab, Fv or other fragments of immunoglobulins using either protein chemistry or recombinant DNA technology. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al. (1993) *Proc. Natl. Acad. Sci. USA* 90:6444-6448; Poljak, R. J., et al. (1994) *Structure* 2:1121-1123).

Still further, an antibody or antigen-binding portion thereof may be part of larger immunoadhesion polypeptides, formed by covalent or noncovalent association of the antibody or antibody portion with one or more other proteins or peptides. Examples of such immunoadhesion polypeptides include use of the streptavidin core region to make a tetrameric scFv polypeptide (Kipriyanov, S. M., et al. (1995) *Human Antibodies and Hybridomas* 6:93-101) and use of a cysteine residue, biomarker peptide and a C-terminal polyhistidine tag to make bivalent and biotinylated scFv polypeptides (Kipriyanov, S. M., et al. (1994) *Mol. Immunol.* 31:1047-1058). Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion polypeptides can be obtained using standard recombinant DNA techniques, as described herein.

Antibodies may be polyclonal or monoclonal; xenogeneic, allogeneic, or syngeneic; or modified forms thereof (e.g. humanized, chimeric, etc.). Antibodies may also be fully human. Preferably, antibodies of the present invention bind specifically or substantially specifically to a biomarker polypeptide or fragment thereof. The terms "monoclonal antibodies" and "monoclonal antibody composition", as used herein, refer to a population of antibody polypeptides that contain only one species of an antigen binding site capable of immunoreacting with a particular epitope of an antigen, whereas the term "polyclonal antibodies" and "polyclonal antibody composition" refer to a population of antibody polypeptides that contain multiple species of antigen binding sites capable of interacting with a particular antigen. A monoclonal antibody composition typically displays a single binding affinity for a particular antigen with which it immunoreacts.

Antibodies may also be "humanized", which is intended to include antibodies made by a non-human cell having variable and constant regions which have been altered to more closely resemble antibodies that would be made by a human cell. For example, by altering the non-human antibody amino acid sequence to incorporate amino acids found in human germline immunoglobulin sequences. The humanized antibodies of the present invention may include amino acid residues not encoded by human germline immunoglobulin sequences (e.g., mutations introduced by random or site-specific mutagenesis in vitro or by somatic mutation in vivo), for example in the CDRs. The term "humanized antibody", as used herein, also includes antibodies in which CDR sequences derived from the germline of another mammalian species, such as a mouse, have been grafted onto human framework sequences.

The term "assigned score" refers to the numerical value designated for each of the biomarkers after being measured in a patient sample. The assigned score correlates to the absence, presence or inferred amount of the biomarker in the sample. The assigned score can be generated manually (e.g., by visual inspection) or with the aid of instrumentation for image acquisition and analysis. In certain embodiments, the assigned score is determined by a qualitative assessment, for example, detection of a fluorescent readout on a graded scale, or quantitative assessment. In one embodiment, an "aggregate score," which refers to the combination of assigned scores from a plurality of measured biomarkers, is determined. In one embodiment the aggregate score is a summation of assigned scores. In another embodiment, combination of assigned scores involves performing mathematical operations on the assigned scores before combining them into an aggregate score. In certain, embodiments, the aggregate score is also referred to herein as the "predictive score."

The term "biomarker" refers to a measurable entity of the present invention that has been determined to be predictive of immune checkpoint therapy effects on a cancer. Biomarkers can include, without limitation, nucleic acids and proteins, including those shown in Table 1, the Examples, and the Figures.

A "blocking" antibody or an antibody "antagonist" is one which inhibits or reduces at least one biological activity of the antigen(s) it binds. In certain embodiments, the blocking antibodies or antagonist antibodies or fragments thereof described herein substantially or completely inhibit a given biological activity of the antigen(s).

The term "body fluid" refers to fluids that are excreted or secreted from the body as well as fluids that are normally not (e.g. amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit).

The terms "cancer" or "tumor" or "hyperproliferative" refer to the presence of cells possessing characteristics typical of cancer-causing cells, such as uncontrolled proliferation, immortality, metastatic potential, rapid growth and proliferation rate, and certain characteristic morphological features. In some embodiments, such cells exhibit such characteristics in part or in full due to the expression and activity of immune checkpoint proteins, such as PD-1, PD-L1, and/or CTLA-4. Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, B cell cancer, e.g., multiple myeloma, Waldenstrom's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematologic tissues, and the like. Other non-limiting examples of types of cancers applicable to the methods encompassed by the present invention include human sarcomas and carcinomas, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, colorectal cancer, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, liver cancer, choriocarcinoma, seminoma, embryonal carcinoma, Wilms' tumor, cervical cancer, bone cancer, brain tumor, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma; leukemias, e.g., acute lymphocytic leukemia and acute myelocytic leukemia (myeloblastic, promyelocytic, myelomonocytic, monocytic and erythroleukemia); chronic leukemia (chronic myelocytic (granulocytic) leukemia and chronic lymphocytic leukemia); and polycythemia vera, lymphoma (Hodgkin's disease and non-Hodgkin's disease), multiple myeloma, Waldenstrom's macroglobulinemia, and heavy chain disease. In some embodiments, cancers are epithelial in nature and include but are not limited to, bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, Brenner, or undifferentiated.

The term "coding region" refers to regions of a nucleotide sequence comprising codons which are translated into amino acid residues, whereas the term "noncoding region" refers to regions of a nucleotide sequence that are not translated into amino acids (e.g., 5' and 3' untranslated regions).

The term "complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The terms "conjoint therapy" and "combination therapy," as used herein, refer to the administration of two or more therapeutic substances, e.g., combinations of anti-immune checkpoint therapies, multiple inhibitors of an immune checkpoint of interest, combinations of immune checkpoint therapy with an inhibitor of PBRM1 (ARID2, BRD7, PHF10, KDM6A, ARID1A, ARID1B, BRG1, BRM, CRB1, EGFR, and the like), and combinations thereof. The different agents comprising the combination therapy may be administered concomitant with, prior to, or following the administration of one or more therapeutic agents.

The term "control" refers to any reference standard suitable to provide a comparison to the expression products in the test sample. In one embodiment, the control comprises obtaining a "control sample" from which expression product levels are detected and compared to the expression product levels from the test sample. Such a control sample may comprise any suitable sample, including but not limited to a sample from a control cancer patient (can be stored sample or previous sample measurement) with a known outcome; normal tissue or cells isolated from a subject, such as a normal patient or the cancer patient, cultured primary cells/tissues isolated from a subject such as a normal subject or the cancer patient, adjacent normal cells/tissues obtained from the same organ or body location of the cancer patient, a tissue or cell sample isolated from a normal subject, or a primary cells/tissues obtained from a depository. In another preferred embodiment, the control may comprise a reference standard expression product level from any suitable source, including but not limited to housekeeping genes, an expression product level range from normal tissue (or other previously analyzed control sample), a previously determined expression product level range within a test sample from a group of patients, or a set of patients with a certain outcome (for example, survival for one, two, three, four years, etc.) or receiving a certain treatment (for example, standard of care cancer therapy). It will be understood by those of skill in the art that such control samples and reference standard expression product levels can be used in combination as controls in the methods of the present invention. In one embodiment, the control may comprise normal or non-cancerous cell/tissue sample. In another preferred embodiment, the control may comprise an expression level for a set of patients, such as a set of cancer patients, or for a set of cancer patients receiving a certain treatment, or for a set of patients with one outcome versus another outcome. In the former case, the specific expression product level of each patient can be assigned to a percentile level of expression, or expressed as either higher or lower than the mean or average of the reference standard expression level. In another preferred embodiment, the control may comprise normal cells, cells from patients treated with combination chemotherapy, and cells from patients having benign cancer. In another embodiment, the control may also comprise a measured value for example, average level of expression of a particular gene in a population compared to the level of expression of a housekeeping gene in the same population. Such a population may comprise normal subjects, cancer patients who have not undergone any treatment (i.e., treatment naive), cancer patients undergoing standard of care therapy, or patients having benign cancer. In another preferred embodiment, the control comprises a ratio transformation of expression product levels, including but not limited to determining a ratio of expression product levels of two genes in the test sample and comparing it to any suitable ratio of the same two genes in a reference standard; determining expression product levels of the two or more genes in the test sample and determining a difference in expression product levels in any suitable control; and determining expression product levels of the two or more genes in the test sample, normalizing their expression to expression of housekeeping genes in the test sample, and comparing to any suitable control. In particularly preferred embodiments, the control comprises a control sample which is of the same lineage and/or type as the test sample. In another embodiment, the control may comprise expression product levels grouped as percentiles within or based on a set of patient samples, such as all patients with cancer. In one embodiment a control expression product level is established wherein higher or lower levels of expression product relative to, for instance, a particular percentile, are used as the basis for predicting outcome. In another preferred embodiment, a control expression product level is established using expression product levels from cancer control patients with a known outcome, and the expression product levels from the test sample are compared to the control expression product level as the basis for predicting outcome. As demonstrated by the data below, the methods of the present invention are not limited to use of a specific cut-point in comparing the level of expression product in the test sample to the control.

The "copy number" of a biomarker nucleic acid refers to the number of DNA sequences in a cell (e.g., germline and/or somatic) encoding a particular gene product. Generally, for a given gene, a mammal has two copies of each gene. The copy number can be increased, however, by gene amplification or duplication, or reduced by deletion. For example, germline copy number changes include changes at one or more genomic loci, wherein said one or more genomic loci are not accounted for by the number of copies in the normal complement of germline copies in a control (e.g., the normal copy number in germline DNA for the same species as that from which the specific germline DNA and corresponding copy number were determined). Somatic copy number changes include changes at one or more genomic loci, wherein said one or more genomic loci are not accounted for by the number of copies in germline DNA of a control (e.g., copy number in germline DNA for the same subject as that from which the somatic DNA and corresponding copy number were determined).

The "normal" copy number (e.g., germline and/or somatic) of a biomarker nucleic acid or "normal" level of expression of a biomarker nucleic acid or protein is the activity/level of expression or copy number in a biological sample, e.g., a sample containing tissue, whole blood, serum, plasma, buccal scrape, saliva, cerebrospinal fluid, urine, stool, and bone marrow, from a subject, e.g., a human, not afflicted with cancer, or from a corresponding non-cancerous tissue in the same subject who has cancer.

As used herein, the term "costimulate" with reference to activated immune cells includes the ability of a costimulatory molecule to provide a second, non-activating receptor mediated signal (a "costimulatory signal") that induces proliferation or effector function. For example, a costimulatory signal can result in cytokine secretion, e.g., in a T cell that has received a T cell-receptor-mediated signal. Immune cells that have received a cell-receptor mediated signal, e.g., via an activating receptor are referred to herein as "activated immune cells."

The term "determining a suitable treatment regimen for the subject" is taken to mean the determination of a treatment regimen (i.e., a single therapy or a combination of different therapies that are used for the prevention and/or treatment of the cancer in the subject) for a subject that is started, modified and/or ended based or essentially based or at least partially based on the results of the analysis according to the present invention. One example is determining whether to provide targeted therapy against a cancer to provide immunotherapy that generally increases immune responses against the cancer (e.g., immune checkpoint therapy). Another example is starting an adjuvant therapy after surgery whose purpose is to decrease the risk of recurrence, another would be to modify the dosage of a particular chemotherapy. The determination can, in addition to the results of the analysis according to the present invention, be based on personal characteristics of the subject to be treated. In most cases, the actual determination of the suitable treatment regimen for the subject will be performed by the attending physician or doctor.

The term "diagnosing cancer" includes the use of the methods, systems, and code of the present invention to determine the presence or absence of a cancer or subtype thereof in an individual. The term also includes methods, systems, and code for assessing the level of disease activity in an individual.

A molecule is "fixed" or "affixed" to a substrate if it is covalently or non-covalently associated with the substrate such that the substrate can be rinsed with a fluid (e.g. standard saline citrate, pH 7.4) without a substantial fraction of the molecule dissociating from the substrate.

The term "expression signature" or "signature" refers to a group of two or more coordinately expressed biomarkers. For example, the genes, proteins, metabolites, and the like making up this signature may be expressed in a specific cell lineage, stage of differentiation, or during a particular biological response. The biomarkers can reflect biological aspects of the tumors in which they are expressed, such as the cell of origin of the cancer, the nature of the non-malignant cells in the biopsy, and the oncogenic mechanisms responsible for the cancer. Expression data and gene expression levels can be stored on computer readable media, e.g., the computer readable medium used in conjunction with a microarray or chip reading device. Such expression data can be manipulated to generate expression signatures.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-ATTGCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

The term "immune cell" refers to cells that play a role in the immune response. Immune cells are of hematopoietic origin, and include lymphocytes, such as B cells and T cells; natural killer cells; myeloid cells, such as monocytes, macrophages, eosinophils, mast cells, basophils, and granulocytes.

The term "immune checkpoint" refers to a group of molecules on the cell surface of CD4+ and/or CD8+ T cells that fine-tune immune responses by down-modulating or inhibiting an anti-tumor immune response. Immune checkpoint proteins are well known in the art and include, without limitation, CTLA-4, PD-1, VISTA, B7-H2, B7-H3, PD-L1, B7-H4, B7-H6, 2B4, ICOS, HVEM, PD-L2, CD160, gp49B, PIR-B, KIR family receptors, TIM-1, TIM-3, TIM-4, LAG-3, BTLA, SIRPalpha (CD47), CD48, 2B4 (CD244), B7.1, B7.2, ILT-2, ILT-4, TIGIT, and A2aR (see, for example, WO 2012/177624). The term further encompasses biologically active protein fragment, as well as nucleic acids encoding full-length immune checkpoint proteins and biologically active protein fragments thereof. In some embodiment, the term further encompasses any fragment according to homology descriptions provided herein.

"Immune checkpoint therapy" refers to the use of agents that inhibit immune checkpoint nucleic acids and/or proteins. Inhibition of one or more immune checkpoints can block or otherwise neutralize inhibitory signaling to thereby upregulate an immune response in order to more efficaciously treat cancer. Exemplary agents useful for inhibiting immune checkpoints include antibodies, small molecules, peptides, peptidomimetics, natural ligands, and derivatives of natural ligands, that can either bind and/or inactivate or inhibit immune checkpoint proteins, or fragments thereof; as well as RNA interference, antisense, nucleic acid aptamers, etc. that can downregulate the expression and/or activity of immune checkpoint nucleic acids, or fragments thereof. Exemplary agents for upregulating an immune response include antibodies against one or more immune checkpoint proteins block the interaction between the proteins and its natural receptor(s); a non-activating form of one or more immune checkpoint proteins (e.g., a dominant negative polypeptide); small molecules or peptides that block the interaction between one or more immune checkpoint proteins and its natural receptor(s); fusion proteins (e.g. the extracellular portion of an immune checkpoint inhibition protein fused to the Fc portion of an antibody or immunoglobulin) that bind to its natural receptor(s); nucleic acid molecules that block immune checkpoint nucleic acid transcription or translation; and the like. Such agents can directly block the interaction between the one or more immune checkpoints and its natural receptor(s) (e.g., antibodies) to prevent inhibitory signaling and upregulate an immune response. Alternatively, agents can indirectly block the interaction between one or more immune checkpoint proteins and its natural receptor(s) to prevent inhibitory signaling and upregulate an immune response. For example, a soluble version of an immune checkpoint protein ligand such as a stabilized extracellular domain can binding to its receptor to indirectly reduce the effective concentration of the receptor to bind to an appropriate ligand. In one embodiment, anti-PD-1 antibodies, anti-PD-L1 antibodies, and anti-CTLA-4 antibodies, either alone or in combination, are used to inhibit immune checkpoints.

"Ipilimumab" is a reRepresentative example of an immune checkpoint therapy. Ipilimumab (previously MDX-010; Medarex Inc., marketed by Bristol-Myers Squibb as YERVOY™) is a fully human anti-human CTLA-4 monoclonal antibody that blocks the binding of CTLA-4 to CD80 and CD86 expressed on antigen presenting cells, thereby, blocking the negative down-regulation of the immune responses elicited by the interaction of these molecules (see, for example, WO 2013/169971, U.S. Pat. Publ. 2002/0086014, and U.S. Pat. Publ. 2003/0086930.

The term "immune response" includes T cell mediated and/or B cell mediated immune responses. Exemplary immune responses include T cell responses, e.g., cytokine production and cellular cytotoxicity. In addition, the term immune response includes immune responses that are indirectly effected by T cell activation, e.g., antibody production (humoral responses) and activation of cytokine responsive cells, e.g., macrophages.

The term "immunotherapeutic agent" can include any molecule, peptide, antibody or other agent which can stimulate a host immune system to generate an immune response to a tumor or cancer in the subject. Various immunotherapeutic agents are useful in the compositions and methods described herein.

The term "inhibit" includes the decrease, limitation, or blockage, of, for example a particular action, function, or interaction. In some embodiments, cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

The term "interaction", when referring to an interaction between two molecules, refers to the physical contact (e.g., binding) of the molecules with one another. Generally, such an interaction results in an activity (which produces a biological effect) of one or both of said molecules.

An "isolated protein" refers to a protein that is substantially free of other proteins, cellular material, separation medium, and culture medium when isolated from cells or produced by recombinant DNA techniques, or chemical precursors or other chemicals when chemically synthesized. An "isolated" or "purified" protein or biologically active portion thereof is substantially free of cellular material or other contaminating proteins from the cell or tissue source from which the antibody, polypeptide, peptide or fusion protein is derived, or substantially free from chemical precursors or other chemicals when chemically synthesized. The language "substantially free of cellular material" includes preparations of a biomarker polypeptide or fragment thereof, in which the protein is separated from cellular components of the cells from which it is isolated or recombinantly produced. In one embodiment, the language "substantially free of cellular material" includes preparations of a biomarker protein or fragment thereof, having less than about 30% (by dry weight) of non-biomarker protein (also referred to herein as a "contaminating protein"), more preferably less than about 20% of non-biomarker protein, still more preferably less than about 10% of non-biomarker protein, and most preferably less than about 5% non-biomarker protein. When antibody, polypeptide, peptide or fusion protein or fragment thereof, e.g., a biologically active fragment thereof, is recombinantly produced, it is also preferably substantially free of culture medium, i.e., culture medium represents less than about 20%, more preferably less than about 10%, and most preferably less than about 5% of the volume of the protein preparation.

The term "KDM6A" refers to a particular lysine demethylase containing a JmjC-domain that catalyzes the demethylation of tri-/di-methylated histone H3. The term "KDM6A" is intended to include fragments, variants (e.g., allelic variants), and derivatives thereof. ReRepresentative human KDM6A cDNA and human KDM6A protein sequences are well-known in the art and are publicly available from the National Center for Biotechnology Information (NCBI). For example, the nucleic acid and amino acid sequences of a representative human KDM6A biomarker (also known as UTX or MGC141941 or bA386N14.2 or DKFZp686A03225) is available to the public at the GenBank database under NM_021140.2 and NP_0066963.2. Nucleic acid and polypeptide sequences of KDM6A orthologs in organisms other than humans are well known and include, for example, mouse KDM6A (NM_009483.1 and NP_033509.1), rat KDM6A (XM_002730185.2 and XP_002730231.1), chimpanzee KDM6A (XM_002806207.1 and XP_002806253.1), chicken KDM6A (XM_416762.3 and XP_416762.3), fruit fly KDM6A (NM_001201844.1 and NP_001188773.1), and worm KDM6A (NM_077049.3 and NP_509450.1). Representative sequences of KDM6A orthologs are presented below in Table 1.

Anti-KDM6A antibodies suitable for detecting KDM6A protein are well-known in the art and include, for example, antibody ab36938 (Abcam), 16F9.1 (EMD Millipore), PA5-31828 (ThermoFisher), NBP1-80628 and H00007403-M05 (Novus Biologicals), etc. Moreover, multiple siRNA, shRNA, CRISPR constructs for reducing KDM6A expression can be found in the commercial product lists of the above-referenced companies, such as siRNA product #sc-76881 and sc-76882 and CRISPER products #sc-514859 from Santa Cruz Biotechnology, as well as multiple RNAi products and CRISPER products from Origene and GenScript (Piscataway, NJ). It is to be noted that the term can further be used to refer to any combination of features described herein regarding KDM6A molecules. For example, any combination of sequence composition, percentage identify, sequence length, domain structure, functional activity, etc. can be used to describe an KDM6A molecule of the present invention.

The term "loss-of-function mutation" for KDM6A refers to any mutation in a KDM6A-related nucleic acid or protein that results in reduced or eliminated KDM6A protein amounts and/or function. For example, nucleic acid mutations include single-base substitutions, multi-base substitutions, insertion mutations, deletion mutations, frameshift mutations, missense mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of KDM6A. Such mutations reduce or eliminate KDM6A protein amounts and/or function by eliminating proper coding sequences required for proper KDM6A protein translation and/or coding for KDM6A proteins that are non-functional or have reduced function (e.g., deletion of enzymatic and/or structural domains, reduction in protein stability, alteration of subcellular localization, and the like). Such mutations are well-known in the art. In addition, a representative list describing a wide variety of structural mutations correlated with the functional result of reduced or eliminated KDM6A protein amounts and/or function is described in the Tables and the Examples.

A "kit" is any manufacture (e.g. a package or container) comprising at least one reagent, e.g. a probe or small molecule, for specifically detecting and/or affecting the expression of a marker of the present invention. The kit may be promoted, distributed, or sold as a unit for performing the methods of the present invention. The kit may comprise one or more reagents necessary to express a composition useful in the methods of the present invention. In certain embodiments, the kit may further comprise a reference standard, e.g., a nucleic acid encoding a protein that does not affect or regulate signaling pathways controlling cell growth, division, migration, survival or apoptosis. One skilled in the art can envision many such control proteins, including, but not limited to, common molecular tags (e.g., green fluorescent protein and beta-galactosidase), proteins not classified in any of pathway encompassing cell growth, division, migration, survival or apoptosis by GeneOntology reference, or ubiquitous housekeeping proteins. Reagents in the kit may be provided in individual containers or as mixtures of two or more reagents in a single container. In addition, instructional materials which describe the use of the compositions within the kit can be included.

The term "neoadjuvant therapy" refers to a treatment given before the primary treatment. Examples of neoadjuvant therapy can include chemotherapy, radiation therapy, and hormone therapy. For example, in treating breast cancer, neoadjuvant therapy can allows patients with large breast cancer to undergo breast-conserving surgery.

The "normal" level of expression of a biomarker is the level of expression of the biomarker in cells of a subject, e.g., a human patient, not afflicted with a cancer. An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

The term "pre-determined" biomarker amount and/or activity measurement(s) may be a biomarker amount and/or activity measurement(s) used to, by way of example only, evaluate a subject that may be selected for a particular treatment, evaluate a response to a treatment such as an anti-immune checkpoint inhibitor therapy, and/or evaluate the disease state. A pre-determined biomarker amount and/or activity measurement(s) may be determined in populations of patients with or without cancer. The pre-determined biomarker amount and/or activity measurement(s) can be a single number, equally applicable to every patient, or the pre-determined biomarker amount and/or activity measurement(s) can vary according to specific subpopulations of patients. Age, weight, height, and other factors of a subject may affect the pre-determined biomarker amount and/or activity measurement(s) of the individual. Furthermore, the pre-determined biomarker amount and/or activity can be determined for each subject individually. In one embodiment, the amounts determined and/or compared in a method described herein are based on absolute measurements. In another embodiment, the amounts determined and/or compared in a method described herein are based on relative measurements, such as ratios (e.g., serum biomarker normalized to the expression of a housekeeping or otherwise generally constant biomarker). The pre-determined biomarker amount and/or activity measurement(s) can be any suitable standard. For example, the pre-determined biomarker amount and/or activity measurement(s) can be obtained from the same or a different human for whom a patient selection is being assessed. In one embodiment, the pre-determined biomarker amount and/or activity measurement(s) can be obtained from a previous assessment of the same patient. In such a manner, the progress of the selection of the patient can be monitored over time. In addition, the control can be obtained from an assessment of another human or multiple humans, e.g., selected groups of humans, if the subject is a human. In such a manner, the extent of the selection of the human for whom selection is being assessed can be compared to suitable other humans, e.g., other humans who are in a similar situation to the human of interest, such as those suffering from similar or the same condition(s) and/or of the same ethnic group.

The term "predictive" includes the use of a biomarker nucleic acid and/or protein status, e.g., over- or underactivity, emergence, expression, growth, remission, recurrence or resistance of tumors before, during or after therapy, for determining the likelihood of response of a cancer to anti-immune checkpoint treatment (e.g., therapeutic antibodies against CTLA-4, PD-1, PD-L1, and the like). Such predictive use of the biomarker may be confirmed by, e.g., (1) increased or decreased copy number (e.g., by FISH, FISH plus SKY, single-molecule sequencing, e.g., as described in the art at least at *J. Biotechnol.*, 86:289-301, or qPCR), overexpression or underexpression of a biomarker nucleic acid (e.g., by ISH, Northern Blot, or qPCR), increased or decreased biomarker protein (e.g., by IHC), or increased or decreased activity, e.g., in more than about 5%, 6%, 7%, 8%, 9%, 10%, 11%, 12%, 13%, 14%, 15%, 20%, 25%, 30%, 40%, 50%, 60%, 70%, 80%, 90%, 95%, 100%, or more of assayed human cancers types or cancer samples; (2) its absolute or relatively modulated presence or absence in a biological sample, e.g., a sample containing tissue, whole blood, serum, plasma, buccal scrape, saliva, cerebrospinal fluid, urine, stool, or bone marrow, from a subject, e.g. a human, afflicted with cancer; (3) its absolute or relatively modulated presence or absence in clinical subset of patients with cancer (e.g., those responding to a particular immune checkpoint therapy or those developing resistance thereto).

The term "pre-malignant lesions" as described herein refers to a lesion that, while not cancerous, has potential for becoming cancerous. It also includes the term "pre-malignant disorders" or "potentially malignant disorders." In particular this refers to a benign, morphologically and/or histologically altered tissue that has a greater than normal risk of malignant transformation, and a disease or a patient's habit that does not necessarily alter the clinical appearance of local tissue but is associated with a greater than normal risk of precancerous lesion or cancer development in that tissue (leukoplakia, erythroplakia, erytroleukoplakia lichen planus (lichenoid reaction) and any lesion or an area which histological examination showed atypia of cells or dysplasia.

The terms "prevent," "preventing," "prevention," "prophylactic treatment," and the like refer to reducing the probability of developing a disease, disorder, or condition in a subject, who does not have, but is at risk of or susceptible to developing a disease, disorder, or condition.

The term "probe" refers to any molecule which is capable of selectively binding to a specifically intended target molecule, for example, a nucleotide transcript or protein encoded by or corresponding to a biomarker nucleic acid. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic molecules.

The term "prognosis" includes a prediction of the probable course and outcome of cancer or the likelihood of recovery from the disease. In some embodiments, the use of statistical algorithms provides a prognosis of cancer in an individual. For example, the prognosis can be surgery, development of a clinical subtype of cancer (e.g., solid tumors, such as lung cancer, melanoma, and renal cell carcinoma), development of one or more clinical factors, development of intestinal cancer, or recovery from the disease.

The term "response to immune checkpoint therapy" relates to any response of the hyperproliferative disorder (e.g., cancer) to an immune checkpoint therapy, such as immune checkpoint therapy, preferably to a change in tumor mass and/or volume after initiation of neoadjuvant or adjuvant chemotherapy. Hyperproliferative disorder response may be assessed, for example for efficacy or in a neoadjuvant or adjuvant situation, where the size of a tumor after systemic intervention can be compared to the initial size and dimensions as measured by CT, PET, mammogram, ultrasound or palpation. Responses may also be assessed by caliper measurement or pathological examination of the tumor after biopsy or surgical resection. Response may be recorded in a quantitative fashion like percentage change in tumor volume or in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of hyperproliferative disorder response may be done early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed. This is typically three months after initiation of neoadjuvant therapy. In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular cancer therapeutic regimen is at least 25%, 30%, 35%, 40%, 45%, 50%, 55%, 60%, 65%, 70%, 75%, 80%, 85%, or more. Additional criteria for evaluating the response to cancer therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence. For example, in order to determine appropriate threshold values, a particular cancer therapeutic regimen can be administered to a population of subjects and the outcome can be correlated to biomarker measurements that were determined prior to administration of any cancer therapy. The outcome measurement may be pathologic response to therapy given in the neoadjuvant setting. Alternatively, outcome measures, such as overall survival and disease-free survival can be monitored over a period of time for subjects following cancer therapy for whom biomarker measurement values are known. In certain embodiments, the doses administered are standard doses known in the art for cancer therapeutic agents. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of a cancer therapy can be determined using well-known methods in the art, such as those described in the Examples section.

The term "resistance" refers to an acquired or natural resistance of a cancer sample or a mammal to a cancer therapy (i.e., being nonresponsive to or having reduced or limited response to the therapeutic treatment), such as having a reduced response to a therapeutic treatment by 25% or more, for example, 30%, 40%, 50%, 60%, 70%, 80%, or more, to 2-fold, 3-fold, 4-fold, 5-fold, 10-fold, 15-fold, 20-fold or more. The reduction in response can be measured by comparing with the same cancer sample or mammal before the resistance is acquired, or by comparing with a different cancer sample or a mammal who is known to have no resistance to the therapeutic treatment. A typical acquired resistance to chemotherapy is called "multidrug resistance." The multidrug resistance can be mediated by P-glycoprotein or can be mediated by other mechanisms, or it can occur when a mammal is infected with a multi-drug-resistant microorganism or a combination of microorganisms. The determination of resistance to a therapeutic treatment is routine in the art and within the skill of an ordinarily skilled clinician, for example, can be measured by cell proliferative assays and cell death assays as described herein as "sensitizing." In some embodiments, the term "reverses resistance" means that the use of a second agent in combination with a primary cancer therapy (e.g., chemotherapeutic or radiation therapy) is able to produce a significant decrease in tumor volume at a level of statistical significance (e.g., $p<0.05$) when compared to tumor volume of untreated tumor in the circumstance where the primary cancer therapy (e.g., chemotherapeutic or radiation therapy) alone is unable to produce a statistically significant decrease in tumor volume compared to tumor volume of untreated tumor. This generally applies to tumor volume measurements made at a time when the untreated tumor is growing log rhythmically.

The terms "response" or "responsiveness" refers to an anti-cancer response, e.g. in the sense of reduction of tumor size or inhibiting tumor growth. The terms can also refer to an improved prognosis, for example, as reflected by an increased time to recurrence, which is the period to first recurrence censoring for second primary cancer as a first event or death without evidence of recurrence, or an increased overall survival, which is the period from treatment to death from any cause. To respond or to have a response means there is a beneficial endpoint attained when exposed to a stimulus. Alternatively, a negative or detrimental symptom is minimized, mitigated or attenuated on exposure to a stimulus. It will be appreciated that evaluating the likelihood that a tumor or subject will exhibit a favorable response is equivalent to evaluating the likelihood that the tumor or subject will not exhibit favorable response (i.e., will exhibit a lack of response or be non-responsive).

An "RNA interfering agent" as used herein, is defined as any agent which interferes with or inhibits expression of a target biomarker gene by RNA interference (RNAi). Such RNA interfering agents include, but are not limited to, nucleic acid molecules including RNA molecules which are homologous to the target biomarker gene of the present invention, or a fragment thereof, short interfering RNA (siRNA), and small molecules which interfere with or inhibit expression of a target biomarker nucleic acid by RNA interference (RNAi).

"RNA interference (RNAi)" is an evolutionarily conserved process whereby the expression or introduction of RNA of a sequence that is identical or highly similar to a target biomarker nucleic acid results in the sequence specific degradation or specific post-transcriptional gene silencing (PTGS) of messenger RNA (mRNA) transcribed from that targeted gene (see Coburn, G. and Cullen, B. (2002) *J. of Virology* 76(18):9225), thereby inhibiting expression of the target biomarker nucleic acid. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs or RNA interfering agents, to inhibit or silence the expression of target biomarker nucleic acids. As used herein, "inhibition of target biomarker nucleic acid expression" or "inhibition of marker gene expression" includes any decrease in expression or protein activity or level of the target biomarker nucleic acid or protein encoded by the target biomarker nucleic acid. The decrease may be of at least 30%, 40%, 50%, 60%, 70%, 80%, 90%, 95% or 99% or more as compared to the expression of a target biomarker nucleic acid or the activity or level of the protein encoded by a target biomarker nucleic acid which has not been targeted by an RNA interfering agent.

The term "sample" used for detecting or determining the presence or level of at least one biomarker is typically whole blood, plasma, serum, saliva, urine, stool (e.g., feces), tears, and any other bodily fluid (e.g., as described above under the definition of "body fluids"), or a tissue sample (e.g., biopsy) such as a small intestine, colon sample, or surgical resection tissue. In certain instances, the method of the present invention further comprises obtaining the sample from the individual prior to detecting or determining the presence or level of at least one marker in the sample.

The term "sensitize" means to alter cancer cells or tumor cells in a way that allows for more effective treatment of the associated cancer with a cancer therapy (e.g., anti-immune checkpoint, chemotherapeutic, and/or radiation therapy). In some embodiments, normal cells are not affected to an extent that causes the normal cells to be unduly injured by the immune checkpoint therapy. An increased sensitivity or a reduced sensitivity to a therapeutic treatment is measured according to a known method in the art for the particular treatment and methods described herein below, including, but not limited to, cell proliferative assays (Tanigawa N, Kern D H, Kikasa Y, Morton D L, Cancer Res 1982; 42: 2159-2164), cell death assays (Weisenthal L M, Shoemaker R H, Marsden J A, Dill P L, Baker J A, Moran E M, Cancer Res 1984; 94: 161-173; Weisenthal L M, Lippman M E, Cancer Treat Rep 1985; 69: 615-632; Weisenthal L M, In: Kaspers G J L, Pieters R, Twentyman P R, Weisenthal L M, Veerman A J P, eds. Drug Resistance in Leukemia and Lymphoma. Langhorne, P A: Harwood Academic Publishers, 1993: 415-432; Weisenthal L M, Contrib Gynecol Obstet 1994; 19: 82-90). The sensitivity or resistance may also be measured in animal by measuring the tumor size reduction over a period of time, for example, 6 month for human and 4-6 weeks for mouse. A composition or a method sensitizes response to a therapeutic treatment if the increase in treatment sensitivity or the reduction in resistance is 25% or more, for example, 30%, 40%, 50%, 60%, 70%, 80%, or more, to 2-fold, 3-fold, 4-fold, 5-fold, 10-fold, 15-fold, 20-fold or more, compared to treatment sensitivity or resistance in the absence of such composition or method. The determination of sensitivity or resistance to a therapeutic treatment is routine in the art and within the skill of an ordinarily skilled clinician. It is to be understood that any method described herein for enhancing the efficacy of a cancer therapy can be equally applied to methods for sensitizing hyperproliferative or otherwise cancerous cells (e.g., resistant cells) to the cancer therapy.

The term "synergistic effect" refers to the combined effect of two or more anti-immune checkpoint agents can be greater than the sum of the separate effects of the anticancer agents alone.

"Short interfering RNA" (siRNA), also referred to herein as "small interfering RNA" is defined as an agent which functions to inhibit expression of a target biomarker nucleic acid, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) RNA 9:493-501 incorporated by reference herein).

RNA interfering agents, e.g., siRNA molecules, may be administered to a patient having or at risk for having cancer, to inhibit expression of a biomarker gene which is overexpressed in cancer and thereby treat, prevent, or inhibit cancer in the subject.

The term "subject" refers to any healthy animal, mammal or human, or any animal, mammal or human afflicted with a cancer, e.g., lung, ovarian, pancreatic, liver, breast, prostate, and colon carcinomas, as well as melanoma and multiple myeloma. The term "subject" is interchangeable with "patient."

The term "survival" includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g. time of diagnosis or start of treatment) and end point (e.g. death, recurrence or metastasis). In addition, criteria for efficacy of treatment can be expanded to include response to chemotherapy, probability of survival, probability of metastasis within a given time period, and probability of tumor recurrence.

The term "therapeutic effect" refers to a local or systemic effect in animals, particularly mammals, and more particularly humans, caused by a pharmacologically active substance. The term thus means any substance intended for use in the diagnosis, cure, mitigation, treatment or prevention of disease or in the enhancement of desirable physical or mental development and conditions in an animal or human. The phrase "therapeutically-effective amount" means that amount of such a substance that produces some desired local or systemic effect at a reasonable benefit/risk ratio applicable to any treatment. In certain embodiments, a therapeutically effective amount of a compound will depend on its therapeutic index, solubility, and the like. For example, certain compounds discovered by the methods of the present invention may be administered in a sufficient amount to produce a reasonable benefit/risk ratio applicable to such treatment.

The terms "therapeutically-effective amount" and "effective amount" as used herein means that amount of a compound, material, or composition comprising a compound of the present invention which is effective for producing some desired therapeutic effect in at least a sub-population of cells in an animal at a reasonable benefit/risk ratio applicable to any medical treatment. Toxicity and therapeutic efficacy of subject compounds may be determined by standard pharmaceutical procedures in cell cultures or experimental animals, e.g., for determining the $LD_{50}$ and the $ED_{50}$. Compositions that exhibit large therapeutic indices are preferred. In some embodiments, the $LD_{50}$ (lethal dosage) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more reduced for the agent relative to no administration of the agent. Similarly, the $ED_{50}$ (i.e., the concentration which achieves a half-maximal inhibition of symptoms) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. Also, Similarly, the $IC_{50}$ (i.e., the concentration which achieves half-maximal cytotoxic or cytostatic effect on cancer cells) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. In some embodiments, cancer cell growth in an assay can be inhibited by at least about 10%, 15%, 20%, 25%, 30%, 35%, 40%, 45%, 50%, 55%, 60%, 65%, 70%, 75%, 80%, 85%, 90%, 95%, or even 100%. In another embodiment, at least about a 10%, 15%, 20%, 25%, 30%, 3%, 40%, 45%, 50%, 55%, 60%, 65%, 70%, 75%, 80%, 85%, 90%, 95%, or even 100% decrease in a solid malignancy can be achieved.

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a biomarker nucleic acid and normal post-transcriptional processing (e.g. splicing), if any, of the RNA transcript, and reverse transcription of the RNA transcript.

As used herein, the term "unresponsiveness" includes refractivity of immune cells to stimulation, e.g., stimulation via an activating receptor or a cytokine. Unresponsiveness can occur, e.g., because of exposure to immunosuppressants or exposure to high doses of antigen. As used herein, the term "anergy" or "tolerance" includes refractivity to activating receptor-mediated stimulation. Such refractivity is generally antigen-specific and persists after exposure to the tolerizing antigen has ceased. For example, anergy in T cells (as opposed to unresponsiveness) is characterized by lack of cytokine production, e.g., IL-2. T cell anergy occurs when T cells are exposed to antigen and receive a first signal (a T cell receptor or CD-3 mediated signal) in the absence of a second signal (a costimulatory signal). Under these conditions, reexposure of the cells to the same antigen (even if reexposure occurs in the presence of a costimulatory polypeptide) results in failure to produce cytokines and, thus, failure to proliferate. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate IL-2 gene transcription induced by a heterologous promoter under the control of the 5' IL-2 gene enhancer or by a multimer of the AP1 sequence that can be found within the enhancer (Kang et al. (1992) *Science* 257:1134).

There is a known and definite correspondence between the amino acid sequence of a particular protein and the nucleotide sequences that can code for the protein, as defined by the genetic code (shown below). Likewise, there is a known and definite correspondence between the nucleotide sequence of a particular nucleic acid and the amino acid sequence encoded by that nucleic acid, as defined by the genetic code.

| GENETIC CODE | |
|---|---|
| Alanine (Ala, A) | GCA, GCC, GCG, GCT |
| Arginine (Arg, R) | AGA, ACG, CGA, CGC, CGG, CGT |
| Asparagine (Asn, N) | AAC, AAT |
| Aspartic acid (Asp, D) | GAC, GAT |
| Cysteine (Cys, C) | TGC, TGT |
| Glutamic acid (Glu, E) | GAA, GAG |
| Glutamine (Gln, Q) | CAA, CAG |
| Glycine (Gly, G) | GGA, GGC, GGG, GGT |
| Histidine (His, H) | CAC, CAT |
| Isoleucine (Ile, I) | ATA, ATC, ATT |
| Leucine (Leu, L) | CTA, CTC, CTG, CTT, TTA, TTG |
| Lysine (Lys, K) | AAA, AAG |
| Methionine (Met, M) | ATG |
| Phenylalanine (Phe, F) | TTC, TTT |
| Proline (Pro, P) | CCA, CCC, CCG, CCT |
| Serine (Ser, S) | AGC, AGT, TCA, TCC, TCG, TCT |
| Threonine (Thr, T) | ACA, ACC, ACG, ACT |
| Tryptophan (Trp, W) | TGG |
| Tyrosine (Tyr, Y) | TAC, TAT |
| Valine (Val, V) | GTA, GTC, GTG, GTT |
| Termination signal (end) | TAA, TAG, TGA |

An important and well known feature of the genetic code is its redundancy, whereby, for most of the amino acids used to make proteins, more than one coding nucleotide triplet may be employed (illustrated above). Therefore, a number of different nucleotide sequences may code for a given amino acid sequence. Such nucleotide sequences are considered functionally equivalent since they result in the production of the same amino acid sequence in all organisms (although certain organisms may translate some sequences more efficiently than they do others). Moreover, occasionally, a methylated variant of a purine or pyrimidine may be found in a given nucleotide sequence. Such methylations do not affect the coding relationship between the trinucleotide codon and the corresponding amino acid.

In view of the foregoing, the nucleotide sequence of a DNA or RNA encoding a biomarker nucleic acid (or any portion thereof) can be used to derive the polypeptide amino acid sequence, using the genetic code to translate the DNA or RNA into an amino acid sequence. Likewise, for polypeptide amino acid sequence, corresponding nucleotide sequences that can encode the polypeptide can be deduced from the genetic code (which, because of its redundancy, will produce multiple nucleic acid sequences for any given amino acid sequence). Thus, description and/or disclosure herein of a nucleotide sequence which encodes a polypeptide should be considered to also include description and/or disclosure of the amino acid sequence encoded by the nucleotide sequence. Similarly, description and/or disclosure of a polypeptide amino acid sequence herein should be considered to also include description and/or disclosure of all possible nucleotide sequences that can encode the amino acid sequence.

Finally, nucleic acid and amino acid sequence information for the loci and biomarkers of the present invention (e.g., biomarkers listed in Table 1) are well known in the art and readily available on publicly available databases, such as the National Center for Biotechnology Information (NCBI). For example, exemplary nucleic acid and amino acid sequences derived from publicly available sequence databases are provided below.

TABLE 1

SEQ ID NO: 1 Human PBRM1 Transcript Variant 1 cDNA Sequence
(NM_018313.4)

```
   1 gcggccgcgg ccggaggagc aatagcagca gccgtggcgg ccacggggcg gggcgcggcg
  61 gtcggtgacc gcggccgggg ctgcaggcgg cggagcggct ggaagttgga ttccatgggt
 121 tccaagagaa gaagagctac ctcccctrcc agcagtgtca gcggggactt tgatgatggg
 181 caccattctg tgtcaacacc aggcccaagc aggaaaagga ggagactttc aatcttcca
 241 actgtagatc ctattgccgt gtgccatgaa ctctataata ccatccgaga ctataaggat
 301 gaacagggca gacttctctg tgagctcttc attagggcac caaagcgaag aaatcaacca
 361 gactattatg aagtggttc tcagcccatt gacttgatga aaatccaaca gaaactaaaa
 421 atggaagagt atgatgatgt taatttgctg actgctgact tccagcttct ttttaacaat
 481 gcaaagtcct attataagcc agattctcct gaatataaag ccgcttgcaa actctgggat
 541 ttgtaccttc gaacaagaaa tgagtttgtt cagaaaggag aagcagatga cgaagatgat
 601 gatgaagatg ggcaagacaa tcagggcaca gtgactgatg gatcttctcc agcttacttg
 661 aaggagatcc tggagcagct tcttgaagcc atagttgtag ctacaaatcc atcaggacgt
 721 ctcattagcg aacttttca gaaactgcct ctaaagtgc aatatccaga ttattatgca
 781 ataattaagg agcctataga tctcaagacc attgcccaga ggatacagaa tggaagctac
 841 aaaagtattc atgcaatggc caaagatata gatctcctcg caaaaaatgc caaaacttat
 901 aatgagcctg gctctcaagt attcaaggat gcaaattcaa ttaaaaaaat attttatatg
 961 aaaaaggctg aaattgaaca tcatgaaatg gctaagtcaa gtcttcgaat gaggactcca
1021 tccaacttgg ctgcagccag actgacaggt ccttcacaca gtaaaggcag ccttggtgaa
1081 gagagaaatc ccactagcaa gtattaccgt aataaaagag cagtacaagg aggtcgttta
1141 tcagcaatta caatggcact tcaatatggc tcagaaagtg aagaagatgc tgctttagct
1201 gctgcacgct atgaagaggg agagtcagaa gcagaaagca tcacttcctt tatggatgtt
1261 tcaaatcctt tttatcagct ttatgacaca gttaggagtt gtcggaataa ccaagggcag
1321 ctaatagctg aacttttta ccatttgcct tcaaagaaaa aatacccgta ttattaccag
1381 caaattaaaa tgcccatatc actacaacag atccgaacaa aactgaagaa tcaagaatat
1441 gaaactttag atcatttgga gtgtgatctg aatttaatgt ttgaaaatgc caaacgctat
1501 aatgtgccca attcagccat ctacaagcga gttctaaaat tgcagcaagt tatgcaggca
1561 aagaagaaag agcttgccag gagagacgat atcgaggacg gagacagact gatctcttca
1621 gccacctctg atactggtag tgccaaaaga aaaagtaaaa agaacataag aaagcagcga
1681 atgaaaatct tattcaatgt tgttcttgaa gctcgagagc caggttcagg cagaagactt
1741 tgtgacctat ttatggttaa accatccaaa aaggactatc ctgattatta taaaatcatc
1801 ttggagccaa tggacttgaa aataattgag cataacatcc gcaatgacaa atatgctggt
1861 gaagagggaa tgatagaaga catgaagctg atgttccgga atgccaggca ctataatgag
1921 gagggctccc aggtttataa tgatgcacat atcctggaga agttactcaa ggagaaaagg
1981 aaagagctgg gcccactgcc tgatgatgat gacatggctt ctcccaaact caagctgagt
2041 aggaagagtg gcatttctcc taaaaaatca aaatacatga ctccaatgca gcagaaacta
2101 aatgaggtct atgaagctgt aaagaactat gtgataaga gggtcgccg cctcagtgcc
2161 atatttctga ggcttccctc tagatctgag ttgcctgact actatctgac tattaaaaag
2221 cccatggaca tggaaaaaat tcgaagtcac atgatggcca acaagtacca agatattgac
2281 tctatggttg aggactttgt catgatgttt aataatgcct gtacataaa tgagccggag
2341 tctttgatct cacaaagatg tcttgttcta tgcttgaaac acgcagagac
2401 ctggagggag atgaggactc tcatgtccca aatgtgactt tgctgattca agagcttatc
2461 cacaatcttt ttgtgtcagt catgagtcat caggatgatg agggaagatg ctacagcgat
2521 tctttagcag aaattcctgc tgtggatccc aactttccta caaaccacc ccttacattt
2581 gacataatta ggaagaatgt tgaaaataat cgctaccgtc ggcttgattt atttcaagag
2641 catatgtttg aagtattgga acgagcaaga aggatgaatc ggacagattc agaaatatat
2701 gaagatgcag tagaacttca gcagttttt attaaaattc gtgatgaact ctgcaaaaat
2761 ggagagattc ttctttcacc ggcactcagc tataccacaa acatttgca taatgatgtg
2821 gagaaagaga gaaggaaaa attgccaaaa gaaatagagg aagataaact aaaacgagaa
2881 gaagaaaaaa gagaagctga aaagagtgaa gattcctctg tgctgcagg cctctcaggc
2941 ttacatcgca catacagcca ggactgtagc tttaaaaaca gcatgtacca tgttggagat
3001 tacgtctatg tggaacctgc agaggccaac ctacaaccac atatcgtctg tattgaaaga
3061 ctgtgggagg attcagctga aaaagaagtt tttaagagtg actattacaa caagttcca
3121 gttagtaaaa ttctaggcaa gtgtgtggtc atgtttgtca aggaatactt taagttatgc
3181 ccagaaaact tccgagatga ggatgttttt gtctgtgaat cacggtattc tgccaaaacc
3241 aaatctttta agaaaattaa actgtggacc atgcccatca gctcagtcag gtttgtccct
3301 cggatgtgc ctctgcctgt ggttcgcgtg gcctctgtat ttgcaaatgc agataaaggt
3361 gatgatgaga agaatacaga caactcagag gacagtcgga ctgaagacaa ttttaacttg
3421 gaaaaggaaa agaagatgat ccctgtgaa atgtccaatg tgaaccagg ttgccactac
3481 tttgagcagc tccattacaa tgacatgtgg ctgaaggttg gcgactgtgt cttcatcaag
3541 tcccatgcc tggtgcgtcc tcgtgtgggc agaattgaaa agtatgggt tcgagatgga
3601 gctgcatatt tttatgcc catcttcatt caccccagaag aaacagagca tggcccaca
3661 aaaatgttct acaaaaaaga agtatttctg agtaatctgg aagaaacctg ccccatgaca
3721 tgtattctcg gaaagtgtgc tgtgttgtca ttcaaggact tcctctcctg caggccaact
3781 gaaataccag aaaatgcat tctgctttgt gagagccgct acaatgagag cgacaagcag
3841 atgaagaaat tcaaaggatt gaagaggttt tcactctctg ctaaagtggt agatgatgaa
3901 atttactact tcagaaaacc aattgttcct cagaaggagc catcaccttt gctggaaaag
3961 aagatccagt tgctagaagc taaattgcc gagttagaag gtggagatga tgatatgaa
4021 gagatgggag aagaagatag tgagtctacc ccaaagtctg ccaaggcag tgcaaagaag
4081 gaaggctcca aacggaaaat caacatgagt ggctacatcc tgttcagcag tgagatgaga
4141 gctgtgatta aggcccaaca cccagactac tcttttcggg agctcagccg cctggtgggg
4201 acagaatgga gaaatcttga gacagccaag aaagcagaat atgaaggcat gatgggtggc
4261 tatccgccag gccttccacc tttgcagggc ccagttgatg gccttgttag catgggcagc
4321 atgcagccac ttcaccctg ggggcctcca cccaccactc ttccgccagg tgtgcctggc
4381 ctccgggca tcccaccacc gggtgtgatg aaccaaggag tggccctat ggtagggact
4441 ccagcaccag gtggaagtcc atatgacaa caggtgggag ttttggggcc tccagggcag
4501 caggcaccac ctccatatcc cggcccacat ccagctggac cccctgtcat acagcagcca
4561 acaacaccca tgtttgtagc tcccccacca aagacccagc ggcttcttca ctcagaggcc
4621 tacctgaaat acattgaagg actcagtgcg gagtccaaca gcattagcaa gtgggatcag
```

TABLE 1-continued

```
4681 acactggcag ctcgaagacg cgacgtccat tgtcgaaaa acaggagag ccgcctaccc
4741 tctcactggc tgaaaagcaa aggggcccac accaccatgg cagatgccct ctggcgcctt
4801 cgagatttga tgctccggga caccctcaac attgccaag catacaacct agaaaatgtt
4861 taatcacatc attacgtttc ttttatatag aagcataaag agttgtggat cagtagccat
4921 tttagttact gggggtgggg ggaaggaaca aaggaggata atttttattg cattttactg
4981 tacatcacaa ggccattttt atatacggac acttttaata agctatttca atttgtttgt
5041 tatattaagt tgactttatc aaatacacaa agatttttt gcatatgttt ccttcgttta
5101 aaaccagttt cataattggt tgtatatgta gacttggagt tttatctttt tacttgttgc
5161 catggaactg aaaccattag aggttttgt cttggcttgg ggtttttgtt ttcttggttt
5221 tgggtttttt tatatatata tataaaagaa caaaatgaaa aaaaacacac acacacaaga
5281 gtttacagat tagtttaaat tgataatgaa atgtgaagtt tgtcctagtt tacatcttag
5341 agaggggagt atacttgtgt ttgtttcatg tgcctgaata tcttaagcca ctttctgcaa
5401 aagctgtttc ttacagatga agtgctttct ttgaaaggtg gttatttagg tttagatgt
5461 ttaatagaca cagcacattt gctctattaa ctcagaggct cactacagaa atatgtaatc
5521 agtgctgtgc atctgtctgc agctaatgta cctcctggac accaggaggg gaaaaagcac
5581 ttttcaatt gtgctgagtt agacatctgt gagttagact atggtgtcag tgattttgc
5641 agaacacgtg cacaaccctg aggtatgttt aatctaggca ggtacgttta aggatatttt
5701 gatctattta taatgaattc acaatttatg cctataaatt tcagatgatt taaaatttta
5761 aacctgttac attgaaaaac attgaagttc gtcttgaaga aagcattaag gtatgcatgg
5821 aggtgattta tttttaaaca taacacctaa cctaacatgg gtaagagagt atggaactag
5881 atatgagctg tataagaagc ataattgtga acaagtagat tgattgcctt catatacaag
5941 tatgtttag tattccttat ttccttatta tcagatgtat ttttctttt aagttcaat
6001 gttgttataa ttctcaacca gaaatttaat actttctaaa atattttta aatttagctt
6061 gtgctttga attacggag aagggaatca taatttaata aaacgcttac tagaaagacc
6121 attacagatc ccaaacactt gggtttggtg accctgtctt tcttatatga ccctacaata
6181 aacattgaa ggcagcatag gatggcagac agtaggaaca ttgtttcact tggcggcatg
6241 ttttttgaaac ctgctttata gtaactgggt gattgccatt tgtgtagagc ttccactgct
6301 gtttataatc tgagagagtt aatctcagag gatgcttttt tcctttttaat ctgctatgaa
6361 tcagtaccca gatgtttaat tactgtactt attaaatcat gagggcaaaa gagtgtagaa
6421 tggaaaaaag tctcttgtat ctagatactt taaatatggg aggccttta acttaattgc
6481 ctttagtcaa ccactggatt tgaatttgca tcaagtattt taaataata tgaatttaaa
6541 aaaatgtatt gcagtagtgt gtcagtacct tattgttaaa gtgagtcaga taaatcttca
6601 attcctggct atttgggcaa ttgaatcatc atgactgta taatgcaatc agattattttt
6661 gtttctagac atccttgaat tacaccaaag aatagtagat ttagttgtgg ttaaattatt
6721 tatttatttc atgcattcat tttatttccc ttaaggtctg gatgagactt ctttggggag
6781 cctctaaaaa aattttcac tggggccac gtgggtcatt agaagccaga gctctcctcc
6841 aggctccttc ccagtgccta gaggtgctat aggaaacata gatccagcca ggggcttccc
6901 taaagcagtg cagcaccggc ccagggcatc actagacagg ccctaattaa gtttttttta
6961 aaaagcctgt gtatttattt tagaatcatg ttttttctgta tattaacttg ggggatatcg
7021 ttaatattta ggatataaga tttgaggtca gccatcttca aaaaagaaaa aaaaaattgac
7081 tcaagaaagt acaagtaaac tatacacctt ttttcataa gttttaggaa ctgtagtaat
7141 gtggcttaga aagtaaatg gcctaaatgt tttcaaaatg taagttcctg tggagaagaa
7201 ttgtttatat tgcaaacggg gggactgagg ggaacctgta ggtttaaaac agtatgtttg
7261 tcagccaact gatttaaaag gcctttaact gttttggttg ttgttttttt tttaagccac
7321 tctccccttc ctatgaggaa gaattgagag gggcacctat ttctgtaaaa tccccaaatt
7381 ggtgttgatg atttttgagct tgaatgtttt catcctgat taaaacttgg tttattctaa
7441 tttctgtatc atatcatctg aggtttacgt ggtaactagt cttataacat gtatgtatct
7501 tttttttgtt gttcatctaa agctttttaa tccaaataaa tacagagttt gcaaagtgat
7561 ttggattaac
```

SEQ ID NO: 2 Human PBRM1 Variant 1 Amino Acid Sequence (NP_060783.3)

```
   1 mgskrrrats psssvsgdfd dghhsvstpg psrkrrrlsn lptvdpiavc helyntirdy
  61 kdeqgrllce ifirapkrrn qpdyyevvsq pidlmkiqqk lkmeeyddvn lltadfqllf
 121 nnaksyykpd speykaackl wdlylrtrne fvqkgeadde dddedgdnq gtvtegsspa
 181 ylkeileqll eaivvatnps grliselfqk lpskvqypdy yaiikepidl ktiaqriqng
 241 syksihamak didllaknak tynepgsqvf kdansikkif ymkkaeiehh emakssslrmr
 301 tpsnlaaarl tgpshskgsl geernptsky yrnkravqgg rlsaitmalq ygseseedaa
 361 laaaryeege seaesitsfm dvsnpfyqly dtvrscrnnq gqliaepfyh ipskkkypdy
 421 yqqikmpisl qqirtklknq eyetldhlec dlnlmfenak rynvpnsaiy krvlklqqvm
 481 qakkkelarr ddiedgdsmi ssatsdtgsa krkskknirk qrmkilfnvv learepgsgr
 541 rlcdlfmvkp skkdypdyyk iilepmdlki iehnirndky ageegmiedm klmfrnarhy
 601 neegsqvynd ahilekllke krkelgplpd dddmaspklk lsrksgispk kskymtpmqq
 661 klnevyeavk nytdkrgrrl saiflrlpsr selpdyylti kkpmdmekir shmmankyqd
 721 idsmvedfvm mfnnactyne pesliykdal vlhkvlletr rdlegdedsh vpnvtlliqe
 781 lihnlfvsvm shqddegrcy sdslaeipav dpnfpnkppl tfdiirknve nnryrrldlf
 841 qehmfevler arrmnrtdse iyedavelqq ffikirdelc kngeillspa lsyttkhlhn
 901 dvekerkekl pkeieedklk reeekreaek sedssgaagl sglhrtysqd csfknsmyhv
 961 gdyvyvepae anlqphivci erlwedsaek evfksdyynk vpvskilgkc vvmfvkeyfk
1021 lcpenfrded vfvcesrysa ktksfkkikl wtmpissvrf vprdvplpvv rvasvfanad
1081 kgddekntdn sedsraednf nlekekedvp vemsngepgc hyfeqlhynd mwlkvgdcvf
1141 ikshglvrpr vgriekvwvr dgaayfygpi fihpeetehe ptkmfykkev flsnleetcp
1201 mtcilgkcav lsfkdflscr pteipendil icesrynesd kqmkkfkglk rfslsakvvd
1261 deiyyfrkpi vpqkepspll ekkiqlleak faeleggddd ieemgeedse stpksakgsa
1321 kkegskrkin msgyilfsse mravikaqhp dysfgelsrl vgtewrnlet akkaeyegmm
1381 ggyppglppl qgpvdglvsm gsmqplhpgg ppphhlppgv pgipgipppg vmnqgvapmv
1441 gtpapggspy gqpvgvlgpp gqqapppypg phpagppviq qpttpmfvap ppktqrllhs
1501 eaylkyiegl saesnsiskw dqtlaarrrd vhlskeqesr lpshwlkskg ahttmadalw
1561 rlrdlmlrdt lnirqaynle nv
```

TABLE 1-continued

SEQ ID NO: 3 Human PBRM1 Transcript Variant 2 cDNA Sequence
(NM_181042.4)

```
   1 gcggccgggg ctgcaggcgg cggagcggct ggcttgccaa cacttggtgt cacatgtgag
  61 cctcccacat gtattcactc tccattccag ctctgtgatt gaactctgct cttattgact
 121 aggggggcagt tgggcaggca tgcctcattc ctggaattga cagtcattcc taataagttg
 181 gattccatgg gttccaagag aagaagagct acctcccctt ccagcagtgt cagcggggac
 241 tttgatgatg ggcaccattc tgtgtcaaca ccaggcccaa gcaggaaaag gaggagactt
 301 tccaatcttc caactgtaga tcctattgcc gtgtgccatg aactctataa taccatccga
 361 gactataagg atgaacaggg cagacttctc tgtgagctct tcattagggc accaaagcga
 421 agaaatcaac cagactatta tgaagtggtt tctcagccca ttgacttgat gaaaatccaa
 481 cagaaactaa aaatggaaga gtatgatgat gttaatttgc tgactgctga cttccagctt
 541 cttttaaca atgcaaagtc ctattataag ccagattctc ctgaatataa agccgcttgc
 601 aaactctggg atttgtacct tcgaacaaga atgagtttg ttcagaaagg agaagcagat
 661 gacgaagatg atgatgaaga tgggcaagac aatcagggca cagtgactga aggatcttct
 721 ccagcttact tgaaggagat cctggagcag cttcttgaag ccatagttgt agctacaaat
 781 ccatcaggac gtctcattag cgaactttt cagaaactgc cttctaaagt gcaatatcca
 841 gattattatg caataattaa ggagcctata gatctcaaga ccattgccca gaggatacag
 901 aatggaagct acaaaagtat tcatgcaatg gccaaagata tagatctcct cgcaaaaaat
 961 gccaaaactt aatgagcc tggctctcaa gtattcaagg atgcaaattc aattaaaaaa
1021 atattttata tgaaaaggc tgaaattgaa catcatgaaa tggctaagtc aagtcttcga
1081 atgaggactc catccaactt ggctgcagcc agactgacag gtccttcaca cagtaaaggc
1141 agccttggtg aagagagaaa tcccactagc aagtattacc gtaataaaag agcagtacaa
1201 ggaggtcgtt tatcagcaat tacaatggca cttcaaatatg gctcagaaag tgaagaagat
1261 gctgctttag ctgctgcacg ctatgaagag ggagagtcag aagcagaaag catcacttcc
1321 tttatggatg tttcaaatc tttttatcag ctttatgaca cagttaggag ttgtcggaat
1381 aaccaagggc agctaatagc tgaaccttt taccatttgc cttcaaagaa aaaatccct
1441 gattattacc agcaaattaa aatgcccata tcactacaac agatccgaac aaaactgaag
1501 aatcaagaat atgaaacttt agatcatttg gagtgtgatc tgaatttaat gtttgaaaat
1561 gccaaacgct ataatgtgcc caattcagcc atctcacgaa gagttctaaa attgcagcaa
1621 gttatgcagg caaagaagaa agagcttgcc aggagagacg atatcgagga cggagacagc
1681 atgatctctt cagccaccct ctgatactgg agtgccaaaa gaaaagtaa aaagaacata
1741 agaaagcagc gaatgaaaat cttattcaat gttgttcttg aagctcgaga gccaggttca
1801 ggcagaagac tttgtgacct atttatggtt aaaccatcca aaaaggacta tcctgattat
1861 tataaaatca tcttggagcc aatgacttg aaaataattg agcataacat ccgcaatgac
1921 aaatatgctg gtgaagaggg aatgatagaa acatgaagc tgatgttccg gaatgccagg
1981 cactataatg aggagggctc ccaggtttat aatgatgcac atatcctgga gaagttactc
2041 aaggagaaaa ggaaagagct gggcccactg cctgatgatg atgcatggc ttctcccaaa
2101 ctcaagctga gtaggaaag tggcatttct cctaaaaaat caaatacat gactccaata
2161 cagcagaaac taaatgaggt ctatgaagct gtaaagaact atactgataa gaggggtcgc
2221 cgcctcagtg ccatatttct gaggcttccc tctagatctg agttgcctga ctactatctg
2281 actattaaaa agcccatgga catggaaaaa attcgaagtc acatgatggc caacaagtac
2341 caagatattg actctatggt tgaggacttt gtcatgatgt ttaataatgc ctgtacatac
2401 aatgagccga gtctttgat ctacaaagat gctcttgttc tacacaaagt cctgcttgaa
2461 acacgcagag acctggaggg agatgaggac tctcatgtcc caaatgtgac tttgctgatt
2521 caagagctta tccacaatct ttttgtgtca gtcatgagtc atcaggatga tgagggaaga
2581 tgctacacgcg attcttagc agaaattcct gctgtgatc ccaacttcc taacaaacca
2641 ccccttacat ttgacataat taggaagaat gttgaaaata atcgctaccg tcggcttgat
2701 ttatttcaag agcatatgtt tgaagtattg aacgagcaa gaagaatgaa tcggacagat
2761 tcagaaatat atgaagatgc agtagaactt cagcagtttt ttattaaaat tcgtgatgaa
2821 ctctgcaaaa atggagagat tcttcttca ccggcactca gctataccac aaaacatttg
2881 cataatgatg tggagaaaga gagaaaggaa aattgccaa aagaaataga ggaagataaa
2941 ctaaaacgag aagaagaaaa aagagaagct gaaaagagtg aagattcctc tggtgctgca
3001 ggcctctcag gcttacatcg cacatacagc caggactgta gctttaaaaa cagcatgtac
3061 catgttggag attacgtcta tgtggaacct gcagaggcca acctacaacc acatatcgtc
3121 tgtattgaaa gactgtggga ggattcagct ggtgaaaaat ggttgtatgg ctgttggttt
3181 taccgaccaa atgaaacatt ccacctggct cacgaaaat ttctagaaaa agaagttttt
3241 aagagtgact attacaacaa agttccagtt agtaaaattc taggcaagtg tgtggtcatg
3301 tttgtcaagg aatactttaa gttatgccca gaaaacttcc gagatgagga tgttttttgtc
3361 tgtgaatcac ggtattctgc caaaaccaaa tcttttaaga aaattaaact gtggaccatg
3421 cccatcagct cagtcaggtt tgtccctcgg gatgtgcctc tgcctgtggt tcgcgtggcc
3481 tctgtatttg caaatgcaga taaggtgat gatgagaaga tacagacaa ctcagaggac
3541 agtcgagctg aagacaattt taacttggaa aaggaaaaag aagatgtccc tgtggaaatg
3601 tccaatggtg aaccaggttg ccactacttt gacagctcc attacaatga catgtggctg
3661 aaggttggcg actgtgtctt catcaagtcc catggcctgc tgcgtcctcg tgtgggcaga
3721 attgaaaaag tatgggttcg agatggagct gcatatttt atggccccat cttcattcac
3781 ccagaagaaa cagagcatga gcccacaaaa atgttctaca aaaagaagt atttctgagt
3841 aatctggaag aaacctgcc tgacatgt attctcagga agtgtgctgt gttgtcattc
3901 aaggacttcc tctcctgcag gccaactgaa ataccagaaa atgacattct gctttgtgtg
3961 agccgctaca atgagagcga caagcagatg aagaaattca aggattgaa gaggttttca
4021 ctctctgcta aagtggtaga tgatgaaatt tactacttca gaaaccaat tgttcctcag
4081 aaggagccat cacctttgct ggaaaagaag atccagttgc tagaagctaa atttgccgag
4141 ttagaaggtg gagatgatga tattgaagag atgggagaag aagatagtga ggtcattgaa
4201 cctccttctc tacctcagct tcagcccccc ctggccagtg agctggacct catgccctac
4261 acacccccac agtctacccc aaagtctgcc aaggcagtg caagaaggga agctccaaa
4321 cggaaaatca acatgagtgg ctacatcctg ttcagcagtg agatgaggc tgtgattaag
4381 gcccaacacc cagactactc tttcggggag ctcagccgcc tggtggggac agaatggaga
4441 aatcttgaga cagccaagaa agcagaatat gaaggtgtga tgaaccaagg agtggcccct
4501 atggtaggga ctccagcacc aggtggaagt ccatatggac aacaggtggg agttttgggg
4561 cctccagggc agcaggcacc acctccatat cccggcccac atccagctgg accccctgtc
4621 atacagcagc caacaacacc catgtttgta gctcccccac caaagaccca gcggcttctt
```

TABLE 1-continued

```
4681 cactcagagg cctacctgaa atacattgaa ggactcagtg cggagtccaa cagcattagc
4741 aagtgggatc agacactggc agctcgaaga cgcgacgtcc atttgtcgaa agaacaggag
4801 agccgcctac cctctcactg gctgaaaagc aaaggggccc acaccaccat ggcagatgcc
4861 ctctggcgcc ttcgagattt gatgctccgg gacaccctca acattcgcca agcatacaac
4921 ctagaaaatg tttaatcaca tcattacgtt tcttttatat agaagcataa agagttgtgg
4981 atcagtagcc attttagtta ctgggggtgg ggggaaggaa caaaggagga taatttttat
5041 tgcattttac tgtacatcac aaggccattt ttatatacgg acacttttaa taagctattt
5101 caatttgttt gttatattaa gttgacttta tcaaatacac aaagattttt ttgcatatgt
5161 ttccttcgtt taaaaccagt ttcataattg gttgtatatg tagacttgga gttttatctt
5221 tttacttgtt gccatggaac tgaaccatt agaggttttt gtcttggctt ggggtttttg
5281 ttttcttggt tttgggtttt tttatatata tataaaaag aacaaaatga aaaaaaacac
5341 acacacacaa gagtttacag attagtttaa attgataatg aaatgtgaag tttgtcctag
5401 tttacatctt agagagggga gtatacttgt gttgtttca tgtgcctgaa tatcttaagc
5461 cactttctgc aaaagctgtt tcttacagat gaagtgcttt ctttgaaagg tggttatta
5521 ggttttagat gtttaataga cacagcacat ttgctctatt aactcagagg ctcactacag
5581 aaatatgtaa tcagtgctgt gcatctgtct gcagctaatg tacctcctgg acaccaggag
5641 gggaaaaagc acttttcaa ttgtgctgag tagacatct gtgagttaga ctatggtgtc
5701 agtgattttt gcagaacacg tgcacaaccc tgaggtatgt ttaatctagg caggtacgtt
5761 taaggatatt ttgatctatt tataatgaat tcacaattta tgcctataaa tttcagatga
5821 tttaaaattt taaacctgtt acattgaaaa acattgaagt tcgtcttgaa gaaagcatta
5881 aggtatgcat qqaqqtqatt tattttaaa cataacacct aacctaacat gggtaagaga
5941 gtatggaact agatatgagc tgtataagaa gcataattgt gaacaagtag attgattgca
6001 ttcatataca agtatgtttt agtattcctt atttccttat tatcagatgt atttttttctt
6061 ttaagtttca atgttgttat aattctcaac cagaaattta atactttcta aaatattttt
6121 taaatttagc ttgtgctttt gaattacagg agaagggaat cataatttaa taaaacgctt
6181 actagaaaga ccattacaga tcccaaacac ttgggttggg tgaccctgtc tttcttatat
6241 gaccctacaa taaacatttg aaggcagcat aggatggcag acagtaggaa cattgtttca
6301 cttggcggca tgttttgaa acctgcttta tagtaactgg gtgattgcca ttgtggtaga
6361 gcttccactg ctgttttaaa tctgagagag ttaatctcag aggatgcttt tttccttta
6421 atctgctatg aatcagtacc cagatgttta attactgca ttattaaatc atgagggcaa
6481 aagagtgtag aatggaaaaa agtctcttgt atctagatac tttaaatatg ggaggccctt
6541 taacttaatt gcctttagtc aaccactgga tttgaatttg catcaagtat tttaaataat
6601 attgaattta aaaaaatgta ttgcagtagt gtgtcagtac cttattgtta aagtgagtca
6661 gataaatctt caattcctgc ctatttgggc aattgaatca tcatgaactg tataatgcaa
6721 tcagattatt ttgtttctag acatccttga attacaccaa agaacatgaa atttagttgt
6781 ggttaaatta tttatttatt tcatgcattc attttatttc ccttaaggtc tggatgagac
6841 ttcttggg agcctctaaa aaaattttc actggggcc acgtgggtca ttagaagcca
6901 gagctctcct ccaggctcct tcccagtgcc taggtgcct ataggaaaca tagatccagc
6961 cagggcttc cctaaagcag tgcagcaccg gcccagggca tcactagaca ggccctaatt
7021 aagttttttt taaaaagcct gtgtatttat tttagaatca tgttttctg tatattaact
7081 tggggatat cgttaatatt taggatataa gatttgaggt cagccatctt caaaaaagaa
7141 aaaaaaattg actcaagaaa gtacaagtaa actatacact ttttttcat aagttttagg
7201 aactgtagta atgtggctta gaaagtataa tggcctaaat gttttcaaaa tgtaagttcc
7261 tgtggagaag aattgtttat attgcaaacg gggggactga ggggaacctg taggtttaaa
7321 acagtatgtt tgtcagccaa ctgatttaaa aggcctttaa ctgtttggt tgttgttttt
7381 ttttaagcc actctccct tcctatgagg aggggcacct atttctgtaa
7441 aatccccaaa ttggtgttga tgattttgag cttgaatgtt ttcatacctg attaaaactt
7501 ggtttattct aatttctgta tcatatcatc tgaggttac gtggtaacta gtcttataac
7561 atgtatgtat ctttttttttg ttgttcatct aaagcttttt aatccaaat
```

SEQ ID NO: 4 Human PBRM1 Variant 2 Amino Acid Sequence (NP_851385.1)
```
   1 mgskrrrats psssvsgdfd dghhsvstpg psrkrrrlsn lptvdpiavc helyntirdy
  61 kdeqgrllce lfirapkrrn qpdyyevvsq pidlmkiqqk lkmeeyddvn lltadfqllf
 121 nnaksyykpd speykaackl wdlylrtrne fvqkgeadde dddedgadnq gtvtegsspa
 181 ylkeileqll eaivvatnps grliselfqk ipskvqypdy yaiikepidl ktiaqriqng
 241 syksihamak didllaknak tynepgsqvf kdansikkif ymkkaeiehh emakssssrmr
 301 tpsnlaaarl tgpshskgsl geernptsky yrnkravqgg rlsaitmalq ygseseedaa
 361 laaaryeege seaesitsfm dvsnpfyqly dtvrscrnnq gqliaepfyh lpskkkypdy
 421 yqqikmpisl qqirtklknq eyetldhlec dlnlmfenak rynvpnsaiy krvlklqqvm
 481 qakkkelarr ddiedgdsmi ssatsdtgsa krkskknirk qrmkilfnvv learepgsgr
 541 rlcdlfmvkp skkdypdyyk iilepmdlki iehnirndky ageegmiedm klmfrnarhy
 601 neegsqvynd ahilekllke krkelgplpd dddmaspklk lsrksgispk kskymtpmqq
 661 klnevyeavk nytdkrgrrl saiflrlpsr selpdyylti kkpmdmekir shmmankyqd
 721 idsmvedfvm mfnnactyne pesliykdal vlhkvlletr rdlegdedsh vpnvtlliqe
 781 lihnlfvsvm shqddegrcy sdslaeipav dpnfpnkppl tfdiirknve nnryrrldlf
 841 qehmfevler arrmnrtdse iyedavelqq ffikirdelc kngeillspa lsyttkhlhn
 901 dvekerkekl pkeieedklk reeekreaek sedssgaagl sglhrtysqd csfknsmyhv
 961 gdyvyvepae anlqphivci erlwedsage kwlygcwfyr pnetfhlatr kflekevfks
1021 dyynkvpvsk ilgkcvvmfv keyfklcpen frdedvfvce srysaktksf kkiklwtmpi
1081 ssvrfvprdv plpvvrvasv fanadkgdde kntdnsedsr aednfnleke kedvpvemsn
1141 gepgchyfeq lhyndmwlkv gdcvfikshg lvrprvgrie kvwvrdgaay fygpifihpe
1201 etehptkmf ykkevflsnl eetcpmtcil gkcavlsfkd flscrpteip endillcesr
1261 ynesdkqmkk fkglkrfsls akvvddeiyy frkpivpqke pspllekkiq lleakfaele
1321 ggdddieemg eedseviepp slpqlqtpla seldimpytp pqstpksakg sakkegskrk
1381 inmsgyilfs semravikaq hpdysfgels rlvgtewrnl etakkaeyeg vmnqgvapmv
1441 gtpapggspy gqqvgvlgpp gqqapppypg phpagppviq qpttpmfvap ppktqrllhs
1501 eaylkyiegl saesnsiskw dqtlaarrrd vhlskeqesr lpshwlkskg ahttmadalw
1561 rlrdlmlrdt lnirqaynle nv
```

TABLE 1-continued

SEQ ID NO: 5 Mouse PBRM1 cDNA Sequence (NM_001081251.1)

```
   1 ggatttacgg cagcactggg aggggtgagg gcggtgaggg cggcgggtgc cggagagacg
  61 gccgcggcca gaggagcgct agcagccgtg gcggccacgg ggcggggctc ggcggtcggg
 121 gaccgcagcc ggggctgcag gcggcggagc ggcgggcttg ccaacacttg gtgtcacatg
 181 tgagcctccc acatgtgtgc actctccatt ccagctctgt gattgaacct tgctcttatt
 241 gactagggg cacttgggca ggcatgcttc attcctggag ttgacagtca tttcataaga
 301 agttggattc catgggttcc aagagaagaa gagccacctc tccttccagc agtgtcagtg
 361 gagactttga tgacgggcac cattctgtgc ctacaccagg cccaagcagg aaaaggagaa
 421 gactgtccaa tcttccaact gtagatccta ttgctgtgtg ccatgaactc tataacacca
 481 tccgagacta taaggatgaa cagggcagac tcctctgtga gctgttcatt agggctccaa
 541 agcggagaaa tcaaccagac tattatgaag tggtttctca gcccattgac ttgatgaaaa
 601 tccaacagaa acttaaaatg gaagagtatg atgatgttaa tctactgact gctgacttcc
 661 agctgctttt taacaatgca aaggcctact ataagccaga ttcccctgag tataaagctg
 721 cttgtaaact ctgggatttg taccttcgaa caagaaatga gtttgttcag aaaggagaag
 781 cagacgatga agatgatgac gaagatgggc aagacaatca aggcacactg gctgacggct
 841 cttctccagg ttatctgaag gagatcctgg agcagcttct tgaagccata gttgtagcca
 901 caaatccatc aggacggctc atcagtgaac tttttcagaa actgccttcc aaagtgcaat
 961 atccagacta ttatgcaata attaaggaac ctatagatct caagaccatt gctcagagga
1021 tacagaatgg aagctacaaa agtatacacg caatggccaa agatatagat cttctagcaa
1081 aaaatgccaa aacatacaat gagcctgggt ctcaagtatt caaggatgcc aattcgatta
1141 aaaaaatatt ttatatgaaa aaggcagaaa ttgaacatca tgaaatgact aaatcaagtc
1201 ttcgaataag gactgcatca aatttggctg cagccaggct gacaggtcct tcgcacaata
1261 aaagcagcct tggtgaagaa agaaaccccca ctagcaagta ttaccgtaat aaaagagcag
1321 tccaaggggg tcgcttgtca gcaattacca tggcacttca gtatggatca gagagtgaag
1381 aggacgctgc tttagctgct gcacgctatg aagaaggaga atctgaagca gagagcatca
1441 cttccttcat ggacgtttcc aacccctttc atcagcttta cgacacagtt aggagctgta
1501 ggaatcacca agggcagctc atagctgaac cttttcttcca tttgccttca aagaaaaaat
1561 acccagatta ttatcagcaa attaaaatgc ccatatcact tcaacagatc agaacaaagc
1621 taaagaacca agaatatgaa actttagatc atttggagtg tgatctgaat ttaatgtttg
1681 aaaatgccaa acgttataac gttcccaatt cagccatcta taagcgagtt ctaaaactgc
1741 agcaagtcat gcaggcaaag aagaaggagc ttgcgaggag agatgacatt gaggacggag
1801 acagcatgat ctcctcagcc acttctgaca ctggtagtgc caaaaggaaa aggaatactc
1861 atgacagtga gatgttgggt ctcaggaggc tatccagtaa aaagaacata agaaaacagc
1921 gaatgaaaat tttattcaat gttgttcttg aagctcgaga gccaggttca ggcagaagac
1981 tttgcgatct atttatggtt aagccatcca agaaggacta tcctgattat tataaaatca
2041 tcttagagcc aatggacctg aaaataattg agcataacat ccgaaatgac aaatatgcag
2101 gtgaagaagg aatgatgaaa gacatgaaac tcatgttccg caatgccagg cactacaatg
2161 aggagggctc ccaggtatac aatgatgccc atatcctgga gaagttactc aaagataaaa
2221 ggaaagagct gggccctctg cctgatgatg atgacatggc ttctcccaaa cttaaattga
2281 gtaggaagag tggtgttttct cctaagaaat caaagtacat gactccaatg cagcagaaac
2341 tgaatgaagt gtatgaagct gtaaagaact atactgataa gagggggtcgc cgccttagtg
2401 ctatatttct aagactcccc tctagatcag agctgcctga ctactacctg accattaaaa
2461 agcccatgga catgaaaaaa attcgaagtc acatgatggc aaacaagtac caagacatag
2521 attctatggt agaggacttt gtcatgatgt ttaataatgc ctgtacctac aatgaaccag
2581 agtctttgat ctacaaagat gcccttgtac tgcataaagt cctccttgag actcggagag
2641 acctggaggg agatgaggat tctcatgtcc ctaatgtgac gttgctgatt caagagctca
2701 tccataacct ttttgtgtca gtcatgagtc atcaggatga cgaagggagg tgttacagcg
2761 actccttagc agaaattcct gctgtggatc ccaactctcc caataaacct cccccttacat
2821 ttgacattat caggaaaaat gttgaaagta atcggtatcg gcgacttgat ttatttcagg
2881 agcatatgtt tgaagtattg gaacgggcaa gaaggatgaa ccggacaagt tccgaaatat
2941 atgaggatgc tgtagaactt cagcagttttt ttattagaat tcgtgatgaa ctctgcaaaa
3001 atggagagat ccttcttttct ccagcactca gctataccac aaaaacttg cataacgatg
3061 tggaaaaaga aaaaaggaa aaattgccta agaaatagag ggaagataaa ctaaaacgcg
3121 aagaagaaaa aagagaagct gaaaaaagtg aagattcctc aggtaccaca ggcctctcag
3181 gcttacatcg tacatacagc caggactgca gctttaagaa cagcatgtat catgtcggag
3241 attatgtcta tgttgaacct gcggaggcca atctacaacc acatatagtg tgtattgaga
3301 gactgtggga ggattcagct ggtgaaaaat ggttgtacgg ctgttggttt tatcggccaa
3361 atgaaacatt ccatttggct cacacgaaaa ttctagaaaa agaagttttt aagagtgact
3421 actacaataa agtacctgtt agtaaaattc taggcaaagt tgtagtcagt tttgtcaagg
3481 aatactttaa attatgtcca gaaaacttttc gcgatgagga tgtttttgtc tgtgaatcga
3541 ggtattctgc caaaaccaaa tcttttaaga aaattaaact gtggaccatg cccatcagtt
3601 cagttagatt tgtccctcgg gatgtgcctt tgcctgtggt ccgagtggcc tctgtgtttg
3661 caaatgcaga taaagggat gatgagaaga atacagacaa tcagatgac aatagagctg
3721 aagacaattt taacttggaa aaggaaaaag aagatgttcc tgtggagatg tccaatggtg
3781 agccaggttg ccactacttt gagcagcttc ggtacaatga catgtggctg aaggttggtg
3841 attgtgtctt catcaaatcc cacggcttgg tgcgcccctcg tgtgggcaga attgagaaag
3901 tatgggtccg agatgggagc gcatattttt atgccctat cttcattcat ccagaagaaa
3961 cagaacatga gcccacaaaa atgttctaca aaaagaagt gttttcgagt aatctggaag
4021 agacctgccc tatgagttgt attctgggga aatgtgcagt gctgtcattc aaggacttcc
4081 tctcctgcag gccaactgaa ataccagaaa atgacattct gctttgtgag agccgctata
4141 atgagagtga caagcagatg aagaagttca agggtttgaa gaggttttca ctctctgcta
4201 aagttgtaga tgatgaaatc tactacttca gaaaccaat cattcctcga aaggaaccct
4261 cacctttgtt agaaaagaag ataaaattgc tagaagctaa atttgcagag ttagaaggag
4321 gagatgatga tattgaggag atgggagaag aggatagtga agtcattgaa gctccatctc
4381 tacctcaact gcagacaccc ctggccatga gttggaacct catgccctat acacccccac
4441 agtctacccc aaagtctgcc aaaggcagtg caaagaagga aagttctaaa cgaaaaatca
4501 acatgagtgg ctacatttttc ttcagcagtg aaatgagagc tgtgattaaa gcccagcacc
4561 cagactactc ttttgggga ctcagcagac tggtgggac agaatggaga aaccttgaaa
4621 cagccaagaa agcagaatat gaagagcggg cagctaaagt tgctgagcag caggagagag
4681 agcgagcagc acagcaacag cagccgagtg cttctcccccg agcaggcacc cctgtggggg
```

TABLE 1-continued

```
4741 ctctcatggg ggtggtgcca ccaccaacac caatggggat gctcaatcag cagttgacac
4801 ctgttgcagg catgatgggt ggctatccgc caggccttcc acctttgcag ggcccagttg
4861 atggccttgt tagcatgggc agcatgcagc cacttcaccc tgggggggcct ccacctcacc
4921 atcttccgcc aggtgtgcct ggcctcccag gcatcccacc accgggtgtg atgaatcaag
4981 gagtagcccc catggtaggg actccagcac caggtggaag tccgtatgga caacaggtag
5041 gagttttggg acctccaggg cagcaggcac cacctccata tcctggtcct catccagctg
5101 gccccctgt catacagcag ccaacaacgc ccatgtttgt ggctccccca ccaaagaccc
5161 aaaggcttct ccactcagag gcctacctga aatacattga aggactcagt gctgaatcca
5221 acagcattag caagtgggac caaactttgg cagctcgaag acgggatgtc catttgtcca
5281 aagaacagga gagccgccta cctctcact ggctcaaaag taaaggggca cacaccacca
5341 tggcagatgc cctctgcgc ctacgggatt taatgcttcg agacactctc aacatccgac
5401 aggcatacaa cctagaaaat gtttaatcac atcactgttt cttctgtgga agcaaagagt
5461 tgtggagcgg tagccatttt agttactggg gtgggaggga ggaacaaagg atgataattt
5521 ttattgcatt ttattgtaca tcacacagcc attttttat aaggacactt ttaataagct
5581 atttcaaatt tggttttgtt acattaagtt gactatcaaa tacacaaaag atttttttg
5641 catatgtttc ctttgtttaa aaccagtttc ataattggtt atatatagta atagtttat
5701 ctttacttgt taaaggactt aaatcatcaa aggttttggc ttggcttagg gtttcgttt
5761 tcttttttat aaatatatat tatatatata tacacatata aaagaaaaaa tgaaaaaaa
5821 gtttacaaat ttaagttgac aatgaaatgt gaagttggtc ctagtttaca tcttagagga
5881 atgtatatgt atgttttaca tgcctaaata tctgcaggtt ttccttacagg taaagcgaag
5941 tgctttgaaa agtttagatt atacatgtgt gacagatgcg gcatatttgc tctattaaca
6001 cagaggctta ctatagaaat ctaaagtcaa tgctgtacat ccatccagtt agtgtaactg
6061 aagggaaatg taactttgtg ctgagttaga catctgtatt gtcagtgatt cttgtagaat
6121 atgtgctcag atctgagtta tatttagttt tggaaggtaa gttgaagagt acttttgatc
6181 agtttatgat tcagtttatg attttagttt ttgccttcat gttatacatt tatgatttga
6241 aactgtacat ctgttaccct gaaaaacatt gaagaaagta ctgaagtgtg catggaggtg
6301 gtttaagcat aatacttaac ccaagaaaga gtgtaagtgg cacaaagctg tgcctgcaca
6361 tagctgtgca gggtagactc cctacataca catggccggg attcttttatt tccttgttat
6421 caattatagt gcttttgttt tttcaggggt ggaattccta accagaaata atactttcta
6481 aaatattta aaattcagct tgtgcttttgg attatagaag gaaattatac tttaagaaaa
6541 tgttcacaaa aaaaaaaaaa aaaaaaggac tattacagat cccaatactt ggatttggtg
6601 accttgtctt tctttctttt cttgagacat ggtcctacta ccaaccctgg ctggactgga
6661 gctcagtgta tagaccaggc tagtctcaaa ctctgcctct tcctcccaag tgctgggatt
6721 aagggcaggt accatagtgc tcagcaacca caaccctgcc tttccaacac ggccctagcg
6781 taagcactga ggcagtgtgc agtgctcagg cagcagcaaa catttcccgg gggtggtttt
6841 gaaccccgctt gggtggtttgt gtggtgctga cgctgccact gccctgttgt tcattgagaa
6901 tgattgttaa atgcacactc tcctttagaa tataacggat cagtactcat gtttaattgc
6961 catgcttaat aaatcatgag aacaaaagag tatagaatgg aaagcattcc ctggtagcta
7021 ctttaaatac aggagccctg taacttaata ccagtagtca accactggat ctcagttttc
7081 atcaagtatt ttaaataaat aatcttaaat tttaaaatac gtactgcaga gtatgccagt
7141 atcttattgt taaaactgaa tcaaataaat cttcgattcc tggttatttg gaccattgac
7201 tcatcatgga ctatataatt taataagatt cttttctctt aaggtatcct tgaattacac
7261 caaagaacca gaaacttaat tttggttaaa ttatttattt atttcatgca ttaattttct
7321 ttttcttttt aaaggtttag atgaggctcc ttagggagtc tctaaaaccg cttcactatc
7381 agcaaccagg agtactagaa gccagagcac tcttcctcct ggctcctccc cagtgctcta
7441 gtgctgtagg aaccaagagc cagccccagg ttccccgagg cagtaaaaat ccagcacagg
7501 gggctgtgtc cctaaggcaa gccctgatta cctttaaaaa aaaccaaaaa aacaaacaaa
7561 aaaaaaaac ctaattaact aaagcattta aggcactatt tattttagaa tcatgctttt
7621 gaagagcatc agtgattact tagggtgtaa tatgtaaaga tcagacatct ccaaaaacag
7681 aaaaagtaca agtaaacaac acactttctc agtgacttttta agaactgtag taatgtggct
7741 taggaaatat aatggcctaa ttgttttcaa aatgtaagtt cctgtgaaga attttgttta
7801 tattgggttg gggacctata ggtttaaaat agaatgtcag tcagctgact taaaaaacat
7861 tggttttact aagtctgcct tccccttcta aggaagaact gagtgggtaa gggacaggtg
7921 tgtaaaatct ccaaatggat gttacagctt tcagcttgaa cgtttgtttc cagacctgat
7981 taaaatttgg tttattctaa ttctgtact atatcatctg aggttttaag tggtaactgg
8041 ttctatacca tgtatgtatc atatgtttgt tcatcaaagc ttttaatcc aaataaaaac
8101 aacagtttgc aaagtga
```

SEQ ID NO: 6 Mouse PBRM1 Amino Acid Sequence (NP_001074720.1)

```
   1 mgskrrrats psssvsgdfd dghhsvptpg psrkrrrlsn lptvdpiavc helyntirdy
  61 kdeqgrllce lfirapkrrn qpdyyevvsq pidlmkiqqk lkmeeyddvn lltadfqllf
 121 nnakayykpd speykaackl wdlylrtrne fvqkgeadde dddedgqdnq gtladgsspg
 181 ylkeileqil eaivvatnps grliselfqk lpskvqypdy yaiikepidl ktiaqriqng
 241 syksihamak didllaknak tynepgsqvf kdansikkif ymkkaeiehh emtksslrir
 301 tasnlaaarl tgpshnkssl geernptsky yrnkravqgg rlsaitmalq ygseseedaa
 361 laaaryeege seaesitsfm dvsnpfhqly dtvrscrnhq gqliaepffh ipskkkypdy
 421 yqqikmpisl qqirtklknq eyetldhlec dlnlmfenak rynvpnsaiy krvlklqghm
 481 qakkkelarr ddiedgdsmi ssatsdtgsa krkrnthdse mlglrrlssk knirkqrmki
 541 lfnvvleare pgsgrrlcdl fmvkpskkdy pdyykiilep mdlkiiehni rndkyageeg
 601 mmedmklmfr narhyneegs qvyndahile kllkdkrkel gplpddddma spklklsrks
 661 gvspkkskym tpmqqklnev yeavknytdk rgrrlsaifl rlpsrselpd yyltikkpmd
 721 mekirshmma nkyqdidsmv edfvmmfnna ctynepesli ykdalvlhkv lletrrdleg
 781 dedshvpnvt lliqelihnl fvsvmshqdd egrcysdsla eipavdpnsp nkppltfdii
 841 rknvesnryr rldlfqehmf evlerarrmn rtdseiyeda velqqffiri rdelckngei
 901 llspalsytt khlhndveke kkeklpkeie edklkreeks reaeksedss gttglsglhr
 961 tysqdcsfkn smyhvgdyvy vepaeanlqp hivcierlwe dsagekwlyg cwfyrpnetf
1021 hlatrkflek evfksdyynk vpvskilgkc vvmfvkeyfk lcpenfrded vfvcesrysa
1081 ktksfkkikl wtmpissvrf vprdvplpvv rvasvfanad kgddekntdn sddnraednf
1141 nlekekedvp vemsngepgc hyfeqlrynd mwlkvgdcvf ikshglvrpr vgriekvwvr
1201 dgaayfygpi fihpeetehe ptkmfykkev flsnleetcp mscilgkcav isfkdflscr
```

TABLE 1-continued

```
1261 pteipendil lcesrynesd kqmkkfkglk rfslsakvvd deiyyfrkpi ipqkepspll
1321 ekkiqlleak faeleggddd ieemgeedse vieapslpql qtplaneldl mpytppqstp
1381 ksakgsakke sskrkinmsg yilfssemra vikaqhpdys fgelsrlvgt ewrnletakk
1441 aeyeeraakv aeqqerereaa qqqqpsaspr agtpvgalmg vvpptpmgm lnqqltpvag
1501 mmggyppglp plqgpvdglv smgsmqplhp ggppphhlpp gvpglpgipp pgvmnqgvap
1561 mvgtpapggs pygqqvgvlg ppgqqapppy pgphpagppv iqqpttpmfv apppktqrll
1621 hseaylkyie glsaesnsis kwdqtlaarr rdvhlskeqe srlpshwlks kgahttmada
1681 iwrlrdlmlr dtlnirqayn lenv
```

SEQ ID NO: 7 Human ARID2 cDNA Sequence Vairant 1 (NM_152641.3, CDS: from 129 to 5636)

```
   1 ggcccatgac tgagcccgc cgccgccggc cgaggaacgg gctccgggct ctggtaggaa
  61 gcgctgggag cgggggcgc ttttaaaaca ccgatcttgg ttttttaaaa acctcctttg
 121 aaaaaataat ggcaaactcg acggggaagg cgcctccgga cgagcggaga aagggactcg
 181 cttttcctgga cgagctgcgg cagttccacc acagcagagg gtcgcctttt aaaaaaatcc
 241 ctgcggtggg tgggaaggag ctggatcttc acggtctcta caccagagtc actactttag
 301 gcggattcgc gaaggttttct gagaagaatc agtgggggaga aattgttgaa gagttcaact
 361 ttcccagaag ttgttctaac gctgcctttg ctttaaaaca gtattacttg cgttacctag
 421 aaaagtacga gaaagttcat cattttgggg aggatgatga tgaggtacca ccaggcaatc
 481 caaagccaca gcttcctatt ggtgcaattc catcttccta caattaccag caacacagtg
 541 tgtcggatta tctgcgtcaa agttatgggc tgtccatgga ctttaattcg ccaaatgatt
 601 ataataaatt ggtgcttttca ctgttatctg gactcccaaa tgaagtggac tttgctatta
 661 acgtatgcac tctcctatca aatgaaagca agcacgtcat gcaacttgaa aaagatccta
 721 aaatcatcac tttactactt gctaatgccg gggtgtttga cgacactttta ggatcctttt
 781 ccactgtatt tggagaagaa tggaaagaga agactgatag agacttcgtt aagttttgga
 841 aagacatcgt tgatgataat gaagttcgtg acctcatttc tgacagaaac aagtctcatg
 901 aaggtacatc aggagaatgg atttgggagt cttttattcca tccacctcga aagctgggca
 961 ttaacgatat tgaaggacga cgggtacttc agattgcagt gattttgaga aatctttcct
1021 ttgaggaggg caatgttaag ctcttggcag ctaatcgtac ctgtcttcgt ttcctattac
1081 ttttctgcaca tagtcatttt atttctttaa ggcaattagg ccttgacaca ttaggaaata
1141 ttgcagctga gcttttactg gacccctgttg atttcaaaac tactcatctg atgtttcata
1201 ctgttacaaa atgtctaatg tcaagggata gatttttaaa gatgagaggc atggaaattt
1261 tgggaaatct ttgcaaagca gaagataatg gtgttttaat ttgtgaatat gtggatcagg
1321 attcctacag agagatcatt tgtcatctca ctttacctga tgtgctgctt gtaatctcaa
1381 cactcgaggt gctatacatg ctcacggaaa tgggagatgt tgcttgcaca aaaattgcaa
1441 aagtagaaaa gagcatagac atgttagtgt gtctggtttc tatggatatt cagatgtttg
1501 gccctgatgc actagctgcg gtaaaactca ttgaacaccc aagttccagt catcaaatgt
1561 tatctgaaat taggccacaa gctatagagc ccagactcat gtagcatctg
1621 ccccagcttc cagagcagtt gtagcgcagc atgttgctcc acctccagga atagtgtgaaa
1681 tagatagtga gaagtttgct tgtcagtggc taaatgctca ttttgaagta aatccagatt
1741 gttctgtttc tcgagcagaa atgtattctg aatacctctc gacttgcagt aaattagctc
1801 gtggtgggaat cctaacatca actggatttt ataaatgtct tagaacggtc tttccaaatc
1861 atacagtgaa gagagtggag gattccagta gcaatgggca ggcacatatt catgtggtag
1921 gagtaaaacg gagggctata ccacttccca ttcagatgta ctatcagcag caaccagttt
1981 ctacttctgt tgttcgtgtt gattctgttc ctgatgtatc tcctgctcct tcacctgcag
2041 gaatccctca tggatcacaa accataggaa accattttca gaggactcct gttgccaacc
2101 aatcttcaaa tctgactgca acacaaatgt ctttttcctgt acaaggtgtt catactgtgc
2161 cacaaactgt ttcaagaatt ccacaaaatc cttcacctca tacccaccag caacaaaatg
2221 ctccagtgac tgtcattcaa agtaaagctc caattccttg tgaagttgtt aaggctacag
2281 ttatccagaa ttccataccc cagacaggag ttcctgttag tattgctgtt ggaggaggac
2341 ctccacagag ttctgttgtt cagaatcata gtacagggcc acaacctgtt acagttgtga
2401 attctcagac attgcttcac catccatctg taattccaca gcagtctcca ttacacacag
2461 tggtaccagg acagatccct tcaggcactc ctgttacagt aattcaacaa gctgtcccac
2521 agagtcatat gtttggcaga gtacagaaca taccagcatg tacttctaca gtttcacagg
2581 gtcaacagtt aatcaccaca tcaccccaac ctgtgcaaac ttcatctcaa cagacatcag
2641 ctggtagcca gtcacaagat actgttatca tagcaccccc acagtatgta acaacttctg
2701 catccaatat tgtctcagca acttcagtac agaattttca ggtagctaca ggacaaatgg
2761 ttactattgc tggtgtccca agtccacaag cctcaagggt agggtttcag aacattgcac
2821 caaaacctct cccttctcag caagtttcat cacagtggt acagcagcct attcaacaac
2881 cacagcagcc aacccaacaa agcgtagtga ttgtaagcca gccagctcaa caaggtcaaa
2941 cttatgcacc agccattcac caaattgttc ttgctaatcc agcagctctt ccagctggtc
3001 agacagttca gctaactgga caacctaaca taactccatc ttcttcacca tcacctgtcc
3061 cagctactaa taaccaagtc cctaccgcca tgtcgccgtc ctctaccccct caatcacagg
3121 gaccacctcc tactgtcagt caaatgttat ctgtgaaaag gcagcaacag cagcaacatt
3181 caccagcacc cccaccacag caggtacaag tacaagttca gcagccccaa caagtacaga
3241 tgcaagttca acctcaacag tcgaatgcag gagttggtca gcctgcctct ggtgagtcga
3301 gtctgattaa acagcttctg cttccgaaac gtggtcctc aacaccaggt ggtaagctta
3361 ttctcccagc tccacagatt cctcccccta ataatgcaag agctcctagc cctcaggtgg
3421 tctatcaggt ggccagtaac caagccgcag gttttggagt gcaggggcaa actccagctc
3481 agcagctatt ggttgggcag caaaatgttc agttggtccc aagtgcaatg ccaccctcag
3541 ggggagtaca aactgtgccc atttcgaact tacaaatatt gccaggtcca ctgatctcaa
3601 atagcccagc aaccattttc caagggactt ctggcaacca gtaaccata acagttgtgc
3661 caaatacgag ttttgcacct gcaactgtga gtcagggaaa tgcaactcag ctcattgctc
3721 cagcaggaat taccatgagc ggaacgcaga caggagttgg acttccagta caaacgcttc
3781 cagccactca agcatctcct ctggacaat catcatgtac tactgctact cccccattca
3841 aaggtgataa ataatttttgc caaaggagg aggaagcaaa ggaagcaaca ggtttacatg
3901 ttcatgaacg taaaattgaa gtcatggaga acccgtcctg ccgacgagga gccacaaaca
3961 ccagcaatgg ggatacaaag gaaaatgaaa tgcatgtggg aagtctttta aatgggagaa
4021 agtacagtga ctcaagtcta cctccttcaa actcaggaa aattcaaagt gagactaatc
4081 agtgctcact aatcagtaat gggccatcat tggaattagg tgagaatgga gcatctggga
```

TABLE 1-continued

```
4141 aacagaactc agaacaaata gacatgcaag atatcaaaag tgatttgaga aaaccgctag
4201 ttaatggaat ctgtgatttt gataaaggag atggttctca tttaagcaaa aacattccaa
4261 atcataaaac ttccaatcat gtaggaaatg gtgagatatc tccaatggaa ccacaaggga
4321 ctttagatat cactcagcaa gatactgcca aaggtgatca actagaaaga atttctaatg
4381 gacctgtatt aactttgggt ggttcatctg tgagcagtat acaggaggct tcaaatgcgg
4441 caacacagca atttagtggt actgatttgc ttaatggacc tctagcttca agtttgaatt
4501 cagatgtgcc tcagcaacgc ccaagtgtag ttgtctcacc acattctaca acctctgtta
4561 tacagggaca tcaaatcata gcagttcccg actcaggatc aaaagtatcc cattctcctg
4621 ccctatcatc tgacgttcgg tctacaaatg gcacagcaga atgcaaaact gtaaagaggc
4681 cagcagagga tactgatagg gaaacagtcg caggaattcc aaataaagta ggagttagaa
4741 ttgttacaat cagtgacccc aacaatgctg gctgcagcgc aacaatggtt gctgtgccag
4801 caggagcaga tccaagcact gtagctaaag tagcaataga aagtgctgtt cagcaaaagc
4861 aacagcatcc accaacatat gtacagaatg tggtcccgca gaacactcct atgccacctt
4921 caccagctgt acaagtgcag ggccagccta acagttctca gccttctcca ttcagtggat
4981 ccagtcagcc tggagatcca atgagaaaac ctggacagaa cttcatgtgt ctgtggcagt
5041 cttgtaaaaa gtggtttcag acacccctcac aggttttcta ccatgcagca actgaacatg
5101 gaggaaaaga tgtatatcca gggcagtgtc tttgggaatg ttgtgagcct tttcagcgac
5161 agcggttttc ttttattacc cacttgcagg ataagcactg ttcaaaggat gccctacttg
5221 caggattaaa acaagatgaa ccaggacaag caggaagtca gaagtcttct accaagcagc
5281 caactgtagg gggcacaagc tcaactccta gagcacaaaa ggccattgtg aatcatccca
5341 gtgctgcact tatggctctg aggagaggat caagaaacct tgtctttcga gattttacag
5401 atgaaaaaga gggaccaata actaaacaca tccgactaac agctgcctta atattaaaaa
5461 atattggtaa atattcagaa tgtggtcgca gattgttaaa gagacatgaa aataacttat
5521 cagtgctagc cattagtaac atggaagctt cctccaccct tgccaaatgc ctttatgaac
5581 ttaattttac agttcagagt aaggaacaag aaaaagactc agaaatgctg cagtgaaaaa
5641 taattccact tacacagtgg gggactcaaa gtcagccaca tttcacatac tgttactgaa
5701 gaaagcacca agtcttaatg gaacaaagac catagaatga attattttat ctcctcccat
5761 gatgctgaga ggaagcttcg tattctgatc tctgagtgaa tccctttgtt ctctgtttaa
5821 aaaaatctaa aaagaaaaag gaaaaaaaaa aaagaactgc tgtgggattg tcaaccagct
5881 tatctgcagg atgtttcaga tctgataaat cctgatgatga actggtatga tcagaattca
5941 gtaccatcca cattggaata tacatggaat attgtaaaac ctacatgagc agatgaaata
6001 gaagcattaa atattttttat ctatatccaa aaaggagcac attttatat ttacaaaacc
6061 gtttaagctg gtttgaataa tttaaaaaag tttcagcaca cctataccc cgatctcaga
6121 ggggggccacc aatatctagc tatggatcgt gtgttttgtt tagaaatcag tagcttggtt
6181 ttcttacttg agccaatata ttttcactta tttattatca taaaaattta ccagtctgaa
6241 tagatcttgt aaatatttgt gaatagaatg aatacctttc atgccactgc agccactgga
6301 aatacattct gcggtgtcct agaagcatca ttggtaggtt ctaaagttt ctagactttc
6361 ctgtcaattg taagtaattg tgatatattc tatgcagtgg atgaatgttc tttaaatttg
6421 tgtaaatact tctgcaaagg tactgatgct gtaaagtcaa aacagttttg tggaactgtg
6481 atttttttt cttttttctt ttttttttc tttttttttt tgtattatac accttgtaga
6541 actcattttg ctggctgaaa gagtatggaa taatatatct catgtcattt tttagaagaa
6601 aaactttttg aaggtatttt ttggttttcc ttaacatgta tccactgtaa acgtttgtcg
6661 tgtacaagct cagagcttgg acagaatttt ttgtatttgt aaattggttt aaatacatgg
6721 aattttatac aggttttctc ctgtgttata tatgcattat gtgcaggtat gatatttct
6781 tcactacttt ttctatctta atatagtgtg gaattttatt gtattattct tccattctta
6841 atactgtacc acattcctga tcagaaaactg ctcacttcct taaattgtct ttttccccc
6901 agcgtgaaat gtatccatt ataactgcct attgcctgtt ctattagcat ccaaaaatgt
6961 ggaaggcctc ccaaccacca tttctgctgt gtccttagga tgtgcagtaa aaaatataga
7021 cctaacagtt tatgttatag aatggcttta tttactttgg tgactgttta tagtttttaa
7081 ataaaagact gaacattttc ttgagtcctt catttctgag tatgcttaag acatcttaaa
7141 aatatagaga gaattctaaa ttcagctgaa ggcaaggtat aacggtcacc tacctatttg
7201 attatatgtt gattgataac atattaaata gagaacaaat aagagaggtc ctttacatga
7261 caaatttgca tgaaataagc agattaacca agtatttatt tttcatcttg ttataatgca
7321 gagcaaatgt agagaacagc aaatgattga tgcagttaaa gctcaatatg cctttttta
7381 ctggatactg tacatttggc taaaagcttt tattgtttga tgttgtgttt cttgactgtt
7441 tattcagaat cacagtgtat ccaaatcttc agcttgaatt tggaggcaga ttcttagagt
7501 gaaaaagcct cagtttccat attaaaaatg ttttaaatat tttgattgaa ttagtaccaa
7561 tgtaaaatct agtttcttcc tgaaggagga tccctggcgc tgtcctgcca tgtctcaaag
7621 gaatgtttga gaaacttcat ctaatattag ttataaggtt gtggaattta tgcttggccc
7681 accttccaag actggcactg cccaacagac accgctgaaa tcatgtgggt atccctagga
7741 tggccttcag agccctcaaa cttacaagca cctggtagtt gacatcatat ggggaatttt
7801 ctattcaccg tacttatcca aaaatctctt ttaaaagta aatttgtgca acaacgttta
7861 tttgaaagat aatgtcttct caaaatcaga actgcagtg gtaattaaat taatagaaaa
7921 gagaacaaac tgcaggttta gaaaaatggt tttcatattc accattcttc cacctcattg
7981 aattgcatgc tgtagttcta gcttttctgc tataatatgt aaatatgact gtagcctttt
8041 aagcttcagt ctcagcagag aatttcctaa atgcgtttga cctaatgaaa ctgatcatgg
8101 cttcccactt aggttttttct tcttataagct ttatagaact atataataat atggacttgc
8161 tgtgtaatgg aattaaagtc ttttgcaca ataagttctg caaaacccctc tcattcatga
8221 aaaggtgctc cttgctagac agaaacttgc tgatttacag tattgttatt tttgtctaaa
8281 gttctgtaaa tacatgcttt aatgttatct ttgagaaatc tatgtaaata atatagtcta
8341 caacatagag actgtataat tctgtgttat atatgtgcct agtgctctgt tggcactcaa
8401 taaaattttaa gtaacaaaat tgataatcat atagcgaagg catatttttc ttccaagctc
8461 aagtcaggat tgtgactata tattaatgag actcagtaat ccaacccaca cctgagaact
8521 cgtctcatta ctttatagtc atgtcatgta tgttttttta accatgaaat gacaataaaa
8581 tgatttttaa aatgagaaaa aaaaaaaaa aaaaaaaa
```

SEQ ID NO: 8 Human ARID2 Amino Acid Sequence Isoform A (NP_6X9854.2)

```
  1 manstgkapp derrkglafl delrqfhhsr gspfkkipav ggkeldlhgl ytrvttlggf
 61 akvseknqwg eiveefnfpr scsnaafalk qyylryleky ekvhhfgedd devppgnpkp
121 qlpigaipss ynyqqhsvsd ylrqsyglsm dfnspndynk lvlsllsglp nevdfainvc
```

TABLE 1-continued

```
 181 tllsneskhv mqlekdpkii tlllanagvf ddtlgststv fgeewkekrd rdtvkfwkdi
 241 vddnevrdli sdrnkshegt sgewiweslf hpprklgind iegqrvlqia vilrnlsfee
 301 gnvkllaanr tclrflllsa hshfislrql gldtlgniaa ellldpvdfk tthlmfhtvt
 361 kclmsrdrfl kmrgmeilgn lckaedngvl iceyvdqdsy reiichltlp dvllvistle
 421 vlymlremgd vactkiakve ksidmlvclv smdiqmtgpd alaavklieh pssshqmlse
 481 irpqaieqvq tqthvasapa sravvaqhva pppgiveids ekfacqwlna hfevnpdcsv
 541 sraemyseyl stcsklargg iltstgfykc lrtvfpnhtv krvedsssng qahihvvgvk
 601 rraiplpiqm yyqqqpvsts vvrvdsvpdv spapspagip hgsqtignhf qrtpvanqss
 661 nltarqmsfp vqgvhtvaqt vsripqnpsp hthqqqnapv tviqskapip cevvkatviq
 721 nsipqtgvpv siavgggppq ssvvqnhstg pqpvtvvnsq tllhhpsvip qqsplhtvvp
 781 gqipsgtpvt viqqavpqsh mfgrvqnipa ctstvsqgqq littspqpvq tssqqtsags
 841 qsqdtviiap pqyvttsasn ivsatsvqnf qvatgqmvti agvpspqasr vgfqniapkp
 901 lpsqqvsstv vqqpiqqpqq ptqqsvvivs qpaqqgqtya paihqivlan paalpagqtv
 961 qlrgqpnitp ssspspvpat nnqvptamss sstpqsqgpp ptvsqmlsvk rqqqqqhspa
1021 ppppqqvqvqv qqpqqvqmqv qpqqsnagvg qpasgessli kqlllpkrgp stpggklilp
1081 apqippppnna rapspqvvyq vasnqaagfg vqgqtpaqql lvgqqnvqlv psamppsggv
1141 qtvpisnlqi lpgplisnsp atifqgtsgn qvtitvvpnt sfapatvsqg natqliapag
1201 itmsgtqtgv glpvqtlpat qaspagqssc ttatpptkgd kiicqkeeea keatglhvhe
1261 rkievmenps crrgatntsn gdtkenemhv gsllngrkys dsslppsnsg kiqsetnqcs
1321 lisngpslel gengasgkqn seqidmqdik sdlrkplvng icdfdkgdgs hlsknipnhk
1381 tsnhvgngei spmepqgtld itqqdtakgd qlerisngpv ltlggssvss iqeasnaatq
1441 qfsgtdllng plasslnsdv pqqrpsvvvs phsttsviqq hqiiavpdsg skvshspals
1501 sdvrstngta ecktvkrpae dtdretvagi pnkvgvrivt isdpnnagcs atmvavpaga
1561 dpstvakvai esavqqkqqh pptyvqnvvp qntpmppspa vqvqgqpnss qpspfsgssq
1621 pgdpmrkpgq nfmclwqsck kwfqtpsqvf yhaatehgqk dvypgqclwe gcepfqrqrf
1681 sfithlqdkh cskdallagl kqdepgqags qksstkqptv ggtsstpraq kaivnhpsaa
1741 lmalrrgsrn lvfrdftdek egpitkhirl taalilknig kysecgrrll krhennlsvl
1801 aisnmeasst lakclyelnf tvqskeqekd semlq
```

SEQ ID NO: 9 Human ARID2 cDNA Sequence Vairant 2 (NM_001347839.1. CDS: from 129 to 5495)

```
   1 ggcccatgac tgagcccgcc cgccgccggc cgaggaatgg gctccgggct ctggtaggaa
  61 gcgctgggag cggggggcgc ttttaaaaca ccgatctggg tttttttaaaa acctcctttg
 121 aaaaaataat ggcaaactcg acggggaagg gcctccggca cgagcggaga aagggactcg
 181 cttttcctgga cgagctgcgg cagttccacc acagcagagg gtcgccttt aaaaagaatcc
 241 ctgcggtggg tgggaaggaa ctggatcttc acggtctcta caccagagtc actactttag
 301 gcggattcgc gaaggttct gagaagaacc agtggggaga aattgttgaa gagttcaact
 361 ttcccagaag ttgtcctaac gctgccttg cttttaaaca gtattacttg cgttacctag
 421 aaaagtacga gaaagttcat cattttgggg aggatgatga tgaggtacca ccaggcaatc
 481 caaagccaca gcttcctatt ggtgcaattc catcttccta caattaccag caacacagtg
 541 tgtcggatta tctgcgtcaa agtatgggc tgtccatgga ctttaattcg ccaaatgatt
 601 ataataaatt ggtgcttta ctgttatctg gactcccaaa tgaagtggac tttgctatta
 661 acgtatgcac tctcctatca aatgaaagca agcacgtcat gcaacttgaa aaagatccta
 721 aaatcatcac tccactactt gctaatgccg gggtgttga cgacactta ggatcctttt
 781 ccactgtatt tggagaagaa tggaaagaga agactgatag agacttcgtt aagttttgga
 841 aagacatcgt tgatgataat gaagtccgtg acctcatttc tgacagaaac aagtctcatg
 901 aaggtacatc aggagaatgg atttgggagt ctttatttca tccacctcga aagctgggca
 961 ttaacgacat tgaaggacag cgggtacttc agatttgcagt gattttgaga aaccttttcct
1021 ttgaggaggg caatgttaag ctcttggcag ctaatcgtac ctgtcttcgt ttcctattac
1081 tttctgcaca tagtcatttt atttctttaa ggcaattagg ccttgacaca ttaggaaata
1141 ttgcagctga gcttttactg gaccctgttg atttcaaaac tactcatctg atgtttcata
1201 ctgttacaaa atgtctaatg tcaagggata gatttttaaa gatgagaggc atggaaattt
1261 tgggaaatct ttgcaaagca gaagataatg gtgttttaat ttgtgaatat gtggatcagg
1321 attcctacag agagatcatt tgtcatctca ctttacctga tgtgctgctt gtaatctcaa
1381 cactcgaggt gctatacatg ctcacggaaa tgggagatgt tgcttgcaca aaaattgcaa
1441 aagtagaaaa gagcatagac atgttagtgt gtctggtttc tatggatatt cagatgtttg
1501 gccctgatgc actagctgcg gtaaaactca ttgaacaccc aagttccagt caccaaatgt
1561 tatctgaaat taggccacaa gctatagagc aagtccaaac ccagactcat gtagcatctg
1621 ccccagctc cagagcagtt gtagcgcagc atgttgctcc acctccagga atagtggaaa
1681 tagatagtga gaagtttgct tgtcagtggc taaacgctca ttttgaagta aatccagatt
1741 gttctgtttc tcgagcagaa atgtattctg aatacctctc gacttgcagt aaaattagctc
1801 gtggtggaac cctaacatca actggatttt ataaatgtct tagaacggtc tttccaaatc
1861 atacagtgaa gagagtggag gattccagta gcaatggtca ggcacatatt catgtggtag
1921 gagtaaaacg gagggctata ccacttccca ttcagatgta ctatcagcag caaccagttt
1981 ctacttctgt tgttcgtgtt gattctgttc ctgatgtatc tcctgctcct tcacctgcag
2041 gaatccctca tggatcacaa accataggaa accattttca gaggactcct gttgccaacc
2101 aatcttcaaa tctgactgca acacaaatgt cttttcctgt acaaggtgtt catactgtga
2161 cacaaactgt ttcaagaatt ccacaaaatc cttccctca tacccaccag caacaaaatg
2221 ctccagtgac tgccattcaa agtaaagctc caatccctg tgaagttgtt aaggctacag
2281 ttatccagaa ttccataccc cagacaggag tccctgttag tattgttgtt ggaggaggac
2341 ctccacagag ttctgttgtt cagaatcata gtacagggcc acaacctgtt acagttgtga
2401 attctcgacc attgcttcac catccatctg taattccaca gcagtctcca ttacacacag
2461 tggtaccagg acagatccct tcaggcactc ctgttacagt aattcaacaa gctgtcccac
2521 agagtcatat gtttggcaga gtacagaaca taccagcatg tacttctaca gtttcacagg
2581 gtcaacagtt aatcaccaa tcaccccaac ctgtgaacaa ttcatctcaa cagacatcag
2641 ctggtagcca gtcacaagat actgttatca tagcaccccc acagtatgta acaacttctg
2701 catccaatat tgtctcagca acttcagtac agaatttca ggtagctaca ggacaaatgg
2761 ttactattgc tggtgtccca agtccacaag cctcaagggt agggtttcag aacattgcac
2821 caaaacctct cccttctcag caagttccat ctacagtggt acagcagcct attcaacaac
2881 cacagcagcc aacccaacaa agcgtagtga ttgtaagcca gccagctcaa caaggtcaaa
```

TABLE 1-continued

```
2941 cttatgcacc agccattcac caaattgttc ttgctaatcc agcagctctt ccagctggtc
3001 agacagttca gctaactgga caacctaaca taactccatc ttcttcacca tcacctgtcc
3061 cagctactaa taaccaagtc cctactgcca tgtcgtcgtc ctctacccct caatcacagg
3121 gaccacctcc tactgtcagt caaatgttat ctgtgaaaag gcagcaacag cagcaacatt
3181 caccagcacc cccaccacag caggtacaag tacaagttca gcagccccaa caagtacaga
3241 tgcaagttca acctcaacag tcgaatgcag gagttggtca gcctgcctct ggtgagtcga
3301 gtctgattaa acagcttctg cttccgaaac gtggtccttc aacaccaggt ggtaagctta
3361 ttctcccagc tccacagatt cctcccccta ataatgcaag agctcctagc cctcaggtgg
3421 tctatcaggt ggccagtaac caagccgcag gttttgcagt gcaggggcaa actccagctc
3481 agcagctatt ggttgggcag caaatgttc agttggtccc aagtgcaatg ccaccctcag
3541 ggggagtaca aactgtgccc atttcgaact acaaatatt gccaggtcca ctgatctcaa
3601 atagcccagc aaccattttc caagggactt ctggcaacca ggtaaccata acagttgtgc
3661 caaatacgag ttttgcacct gcaactgtga gtcagggaaa tgcaactcag ctcattgctc
3721 cagcaggaat taccatgagc ggaacgcaga caggagttgg acttccagta caaacgcttc
3781 cagccactca agcatctcct gctggacaat catcatgtac tactgctact cccccattca
3841 aaggtgataa ataatttgc caaaaggagg aggaagcaaa ggaagcaaca ggtttacatg
3901 ttcatgaacg taaaaattga gtcatggaga cccgtcctg ccgacgagga gccacaaaca
3961 ccagcaatgg ggatacaaag gaaaatgaaa tgcatgtggg aagtctttta aatgggagaa
4021 agtacagtga ctcaagtcta cctccttcaa actcaggaa aattcaaagt gagactaatc
4081 agtgctcact aatcagtaat gggccatcat tggaattagg tgagaatgga gcatctggga
4141 aacagaactc agaacaaata gacatgcaag atatcaaaag tgatttgaa aaaccgctag
4201 ttaatggaat ttgtgatttc gataaaggag acggttctca tttaagcaaa aacattccaa
4261 atcataaac ttccaatcat gtaggaaatg gcgagatatc tccaatggaa ccacaaggga
4321 ccttagatat cactcagcaa gatactgcca aaggtgatca actagaaaga atttctaatg
4381 gacctgtatt aactttgggt ggtccatctg tgagcagtat acaggaggct tcaaatgcgg
4441 caacacagca atttagtggt actgatttgc ttaatgacc tctagcttca agtttgaatt
4501 cagatgtgcc tcagcaacgc ccaagtgtag ttgtcccacc acattctaca acctctgtta
4561 tacagggaca tcaaatcata gcagttcccg actcaggatc aaaagtatcc cattctcctg
4621 ccctatcatc tgacgttcgg tctacaaatg gcacagcaga atgcaaaact gtaaagaggc
4681 cagcagagga tactgatagg gaaacagtcg caggaattcc aaataaagta ggagttagaa
4741 ttgttacaat cagtgacccc aacaatgctg gctgcagcgc aacaatggtt gctgtgccag
4801 caggagcaga tccaagcact gtagctaaag tagcaacaga aagcgccgtt cagcaaaagc
4861 aacagcatcc accaacatat gtacagaatg tggtcccgca gaacactcct atgccaccttt
4921 caccagctgc acaagtgcag ggccagccta acagttctca gccttctcca ttcagcggat
4981 ccagtcagcc tggagatcca atgagaaaac ctggacagaa cttcatgtgt ctgtggcagt
5041 cttgtaaaaa gtggtttcag acaccctcac aggttttcta ccatgcagca actgaacatg
5101 gaggaaaaga tgtatatcca gggcagcgtc tttgggaagg ttgtgagcct tttcagcgac
5161 agcggctttc ttttattacc cacttgcagg ataagcactg ttcaaaggat gccctacttg
5221 caggattaaa acaagatgaa ccaggacaag caggaagtca gaagtcttct accaagcagc
5281 caactgtagg gggcacaagc tcaactccta gagcacaaaa ggccattgtg aatcatccca
5341 gtgctgcact tatggctctg aggagaggat caagaaacct tgtctttcga gattttacag
5401 atgaaaaga gggaccaata actaaacaca tccgactacc agctgcctta atattaaaaa
5461 atattggtaa atattcagaa tgtggtcgca ggcgagtaat atgttttctg tagccaaagt
5521 gaatttagtt tattttattt ttacatataa gttaataaaa ttagataact gtattttctt
5581 cattgttttt ctcaccaatt ttgcaaatac atccaaaagt ttatgcctag gtcaggccat
5641 gatgagctct taaaagtcaa aaataaatag aagttaaaac aaccaaaaaa aaaaaaaaaa
5701 aaa
```

SEQ ID NO: 10 Human ARID2 Amino Acid Sequence Isoform B (NP_001334768.1)
```
   1 manstgkapp derrkglafl delrqfhhsr gspfkkipav ggkeldlhgl ytrvttlggf
  61 akvseknqwg eiveefnfpr scsnaafalk qyylryleky ekvhhfgedd devppgnpkp
 121 qlpigaipss ynyqqhsvsd ylrqsyglsm dfnspndynk lvlsllsglp nevdfainvc
 181 tllsneskhv mqlekdpkii tllllanagvf ddtlgsfstv fgeewkektd rdfvkfwkdi
 241 vddnevrdli sdrnkshegt sgewiweslf hpprklgind iegqrvlqia vilrnlsfee
 301 gnvkllaanr tclrflllsa hshfislrql gldtlgniaa ellldpvdfk tthlmfhtvt
 361 kclmsrdrfl kmrgmeilgn lckaedngvl iceyvdqdsy reiichltlp dvllvistle
 421 vlymltemgd vactkiakve ksidmlvclv smdiqmfgpd alaavklieh pssshqmlse
 481 irpqaieqvq tqthvasapa sravvaqhva pppgiveids ekfacqwlna hfevnpdcsv
 541 sraemyseyl stcsklargg iltstgfykc lrtvfpnhtv krvedsssng qahihvvgvk
 601 rraiplpiqm yyqqqpvsts vvrvdsvpdv spapspagip hgsqtighnf qrtpvanqss
 661 nltatqmsfp vqgvhtvaqt vsripqnpsp hthqqqnapv tviqskapip cevvkatviq
 721 nsipqtgvpv siavgggppq ssvvqnhstg pqpvtvvnsq tllhhpsvip qqspplhtvvp
 781 gqipsgtpvt ctiqqavpqsh mfgrvqnipa ctstvsqpvq tssqqtsags
 841 qsqdtviiap pqyvttsasn ivsatsvqnf qvatqqmvti agvpspqasr vgfqniapkp
 901 lpsqqvsstv vqqpiqqpqq ptqqsvvivs qpaqgqtya paihqivlan paalpagqtv
 961 qltgqpnitp ssspspvpat nnqvptamss sstpqsqgpp ptvsqmlsvk rqqqqhspa
1021 pppqqvqvqv qqpqqvqmqv qpqqsnagvg qpasgessli kqlllpkrgp stpgqklilp
1081 apqipppnna rapspqvvyq vasnqaagfg vqgqtpaqql lvgqqnvqlv psamppsggv
1141 qtvpisnlqi lpgplisnsp atifqgtsgn qvtitvvpnt sfapatvsgq natqliapag
1201 itmsgtqtgv glpvqtlpat qaspagqssc ttatppfkgd kiicqkeeea keatglhvhe
1261 rkievmenps crrgatntsn gdtkenemhv gsllngrkys dsslppsnsg kiqsetnqcs
1321 lisngpslel gengasgkqn seqidmqdik sdlrkplvng icdfdkgdgs hlsknipnhk
1381 tsnhvgngei spmepqgtld itqqdtakgd qlerisngpv ltlggssvss iqeasnaatq
1441 qfsgtdllng plasslnsdv pqqrpsvvvs phsttsviqg hqiiavpdsg skvshspals
1501 sdvrstngta ecktvkrpae dcdretvagi pnkvgvrivt isdpnnagcs atmvavpaga
1561 dpstvakvai esavqqkqqh pptyvqnvvp qntpmppspa vqvqgqpnss qpspfsgssq
1621 pgdpmrkpgq nfmclwqsck kwfqtpsqvf yhaatehggk dvypgqclwe gcepfqrqrf
1681 sfithlqdkh cskdallagl kqdepgqags qksstkqptv ggtsstpraq kaivnhpsaa
1741 lmalrrgsrn lvfrdftdek egpitkhirl taalilknig kysecgrr
```

TABLE 1-continued

SEQ ID NO 11 Mouse ARID2 cDNA Sequence (NM_175251.4. CDS: from 129 to 5495)

```
   1 gcgccgccgc cgccgccgcc gccgccgccg ccgccgccac cgccggccca tgactgagcc
  61 ccgccaccgc cggccgagga atgggctccg ggcgctggta gggagcgcgg ggagcggggg
 121 ccgcgtttga accgcgatct gggttttttc gggagaccct ctttggcaaa ataatggcaa
 181 actcgacggg gaaggcgcct ccggacgagc ggaggaaggg actggctttc ctggacgagc
 241 tgcggcagtt ccaccacagc agagggtcgc cgtttaagaa gatccctgcg gtgggtggga
 301 aggagctgga tcttcacggg ctctacacca gagtcactac tttaggcgga ttcgcggaagg
 361 ttttctgagaa gaatcagtgg ggagaaattg ttgaagagtt caactttccc agaagttgtt
 421 ccaacgctgc ctttgcttta aaacagtatt acttgcgtta tctagaaaag tacgagaaag
 481 ttcatcattt tggggaagat gatgatgagg taccaccagg caatccaaag ccacagcttc
 541 ctattggtgc aatcccatct tcctacaatt accagcaaca cagcgtgtca gattatctac
 601 gccaaagtta tgggttatct atggatttta attcgccaaa tgattataat aaactggtgc
 661 tttcactgtt atctggactc ccaaatgaag tggacttcgc tattaatgtg tgcactctcc
 721 tatcaaatga aagcaagcac gtcatgcagc ttgagaagga tcccaaaatc atcactttac
 781 tgctcgctaa tgcgggggtg ttcgatgaca ctttaggatc attctcttct gtctttggag
 841 aagagtggcg agagaagact gatagagact ttgttaagtt ttggaaagac attgttgatg
 901 acaatgaagt gcgagatctc atttctgaca gaaacaaggc tcatgaagat acaccaggag
 961 aatggatttg gaatctttta tttcatccac ctcgaaagct gggcattaat gacatcgaag
1021 gccagcgggt tctgcagatc gcagtgatct tgcggaacct ctcctttgag gagagcaatg
1081 ttaagctctt ggcagctaat cgcacctgtc tgcgtttcct gttgctctct gcacacagtc
1141 actttatttc attaaggcag ctaggcctgg acacctaggg gaatatcgca gctgagcttt
1201 tactggaccc tgtggatttc agaaccactc atctgatgtt tcacactgtt acaaaatgcc
1261 tgatgtcaag ggataggttt ttaaagatga ggggcatgga aattttggga aatctctgca
1321 aagcagagga taacggttgt ttgatttgtg aatatgtgga tcaagattcc tatagagaga
1381 taatttgtca ccccactctg cccgatgtgc tgctggtgac cccaaccctg gaggtgctgt
1441 acatgctcac tgaaatgggg gacgtggcct gcacaaagat cgcgaaagtg gagaagagca
1501 tagacgtgct ggtgtgtctg tctctatgg acgctcagat gtttggacct gacgcacttg
1561 ctgccgtgaa gctcattgag catccgagct ccagtcacca agtgttatca gagattaggc
1621 cgcaagccat agagcaggtc caaacccaga cccacatagc ctccggtcca gcttccagag
1681 cagttgtagc acagcatgct gccccccctc caggaatcgt ggaaatagac agtgagaagt
1741 tcgcttgtca gtggctaaat gctcattttg aagtaaatcc agactgttcc gtctctcggg
1801 cagaaatgta ttcagagtac ctctcaactt gcagtaaatt agctcgcggt ggcatcctca
1861 catcaactgg gttttataag tgtcttagaa cagtttttcc aaatcataca gtgaagaggg
1921 tagaagattc cactagcagt gggcaggcgc atatccatgt catagggagtg aagcggcggg
1981 ctctcccgct ccccatccag atgtactatc agcagcagcc aatttccact cctgttgtcc
2041 gtgttgatgc tgttgctgat ctatctccaa ctccttcacc tgcaggaatc cctcatggac
2101 cacaggctgc agggaatcag tttcagagga ctcctgtcac caatcaatct tcaaatttga
2161 ctgcaacaca aatgtctttt ccggtacaag gcattcatac tgtgcacaga actgtttcca
2221 gaattccacc aaatccttca gttcatacccc accagcaaca aaattctcca gtaactgtca
2281 ttcagaataa agctccaatt ccttgtgaag tcgttaaggc aacagtaatc cagaactctg
2341 tgccccagac ggcagttcct gtgagtatct tcgttggagg agcacctgca cagaattctg
2401 tgggtcagaa ccatagtgca gggccacagc ctgttacagt tgtaaattct cagacattac
2461 ttcaccatcc ttctgtgatg ccacagccat ctccactaca cagtggtg cccggacagg
2521 tcccttcagg cactcctgtc acagtaatcc agcagactgc accgcagagt cgtatgtttg
2581 gacgagtaca gagcatacca gcgtgtacat ctaccgtctc acagggtcag cagttaatca
2641 ccacatcacc acagcctatg cacacttcac ctcaacagac agcagctggt agccagccac
2701 aagacactgt tatcatagca cccccacagt acgtaacaac ttctgcatcc aatatcgtct
2761 cagcgacttc agtacagaat ttccaggtag ctacaggaca ggtggtcacc atagctggtg
2821 tcccgagccc acagccctcc agggtaggat tccagaacat tgcgcccaag ccacttcctt
2881 ctcagcaagt ttcaccatca gtggtccagc agcctattca acaaccacag cagcctgctc
2941 agcagagtgt agtgattgtg agcagccag cacagcaagg ccaggcgtac gcaccagcca
3001 ttcaccagat cgttctcgct aacccggcag ctctccctgc cggtcagacg gttcagctaa
3061 ctggacaacc aaacataact ccatcgtcat caccatcgcc tgtcccgcct actaataacc
3121 aagtccctac tgccatgtca tcttcttcca cccttcagtc acagggaccc cctcctactg
3181 tcagtcagat gctctctgtg aagaggcagc agcagcagca gcactcacca gcagcgccag
3241 cacagcaggt ccaggtccag gttcagcagc cgcagcaggt ccaggtgcaa gtccagccgc
3301 agcaaccgag tgctgggtc ggtcagcctg ctcccaacga gtctagtctc atcaagcagc
3361 tgctgctgcc aaagcggggc ccttcaaccc caggggcaca gcttatcctc ccagcccctc
3421 agattcctcc ccctaacaat gcaagagctc ctagccctca gtggtctat caggtggcca
3481 ataaccaagc agctgggtttt ggagtgcagg ggcaaactcc ggctcagcag ctattggttg
3541 ggcagcaaaa tgttcagttg gtccaaagtg caatgccacc cgcaggggga gtgcaaaccg
3601 tgcccatttc gaacttacaa atattgccgg gtccgctgat ctcaaacagc ccagcaacca
3661 ttttccaagg gacttctggc aaccaggtaa ctataacagt tgtgccaaat accagttttg
3721 caactgcgac tgtgagtcag ggaaacgctg ctcagctcat tgcgccagcc ggtcttagca
3781 tgagcggagc gcaggcaagc gctggacttc aggtcgagac gcttccagcc ggacaatcag
3841 cgtgtaccac tgctcccctc ccgttcaaag gcgacaagat catttgccaa aaggaggagg
3901 aggcaaagga agcaacaggt ctacatgttc atgaacgaa gattgaggtc atggagaatc
3961 cttcctgtcg gcgcaggaac acaaacacca gcaacgggga tacaagtgag agtgaactcc
4021 aggtgggaag tcttttaaat gggagaaagt atagtgactc aagtctacct ccttcaaact
4081 cagggaaact tcagagtgag acgagccagt gctcactaat cagcaatggg ccatcgttgg
4141 aactaggtga gaatggagcg cctggaaaac agaactcaga accagtagac atgcaggatg
4201 tcaaaggtga tctgaaaaaa gccctcgtca atggaatctg tgattttgat aaggagatg
4261 gttctcattt aagcaaaaac attccaaatc acaaaacttc taatcatgta ggaaatggtg
4321 agatatctcc agtagaacca caagggactt cgggtgccac tcagcaagat actgccaaag
4381 gtgaccaact agaaagagtt tctaatggac ctgtgttaac tctgggtggg tcaccgtcca
4441 caagcagtat gcaagaagcc ccgagtgtgg cgacaccgcc gttgagtggt actgacctgc
4501 ctaacggacc tctagcttca agtttgaatt cagatgtgcc tcagcaacgc ccaagtgtag
4561 ttgtctcacc acattctaca gcccctgtca tacaggggca tcaagtcata gcagttcccc
4621 actcaggacc tagagtgacc ccttctgctc tatcatctga tgctcggtct acaaacggca
```

TABLE 1-continued

```
4681 cagccgagtg caaaactgta aagaggccgg cagaggataa tgatagggac actgtcccgg
4741 gaatcccaaa taaagtaggg gttagaattg ttacaatcag cgaccccaac aatgctggct
4801 gcagtgcaac catggttgcg gtcccagctg gagcggaccc aagcactgta gcgaaagtag
4861 caatagaaag tgctgctcag caaaagcagc agcatccacc gacctacatg cagagtgtgg
4921 ccccacagaa cactcctatg ccaccttcac cagctgtaca agtgcaggge cagcctagca
4981 gttctcagcc ttctccagtc agtgcgtcca gtcagcatgc agatccagtg agaaaacctg
5041 ggcagaactt catgtgtctg tggcagtctt gtaaaaagtg gtttcagact ccctcacaag
5101 tgttctatca tgcagctact gaacatggag gaaaagatgt gtatccgggg cagtgtcttt
5161 gggaaggctg tgagccttte caacggcaga ggttctcttt cattacccac ttacaggata
5221 agcactgttc aaaggatgcc ctgcttgcag gattaaagca agatgaacca ggacaagtgg
5281 caaatcaaaa atcttctacc aagcagccca ccgtgggggg cacaggctct gcgcccagag
5341 cccagaaggc cattgcaagc caccccagtg ctgcactcat ggctctgcgg agaggctcaa
5401 ggaacctcgt cttccgggac ttcacagatg aaaaagaggg accaataact aaacacatcc
5461 gactaacagc tgccttaata ttaaaaaata ttggtaaata ctcagagtgt gggcgcagat
5521 tgttaaagag acatgaaaac aacttatcag tgctcgccat tagtaacatg gaagcttcct
5581 ctaccccttgc caaatgcctt tatgaactta attttacagt tcagagtaaa gaacaagaaa
5641 aagactcaga aatgctgtag tgaatcctac cccactgaca cagtgggggt tcaaagtcaa
5701 atacatttca catactgtta ctgaagaaag caccaagtct taatggagca gagaccatag
5761 aatgaattat tttgtgtcct ccatgatgct gagaggaaac ttcgtattct gatctctgaa
5821 cgaatccctt tctttttctgt taaaaaaaaa aaatctaaaa aggaaaaaaa aaaaaaaaaa
5881 aacaaaaact gctgtgggat tgtcaaccag cttatctgca ggatgtctcg ggatctggcca
5941 atcctgatgg aaactggtgc gatcagaatt ctgtaccatc cacattggaa tatacatgga
6001 atagtgtaaa acctacgtga gcagatgaaa tagaagcatt aaatatttttt atctatatcc
6061 aaaaaggagc acattttttat atttacagaa ccatttaagc tggtttgaat aacgacagag
6121 tttgagcaca cctatcccc agcttcagag gggccaccaa tatctgactg tggatcgtgt
6181 gttttgttta gaatcagtag cttggctttc ttacttgagc caatatattt tcacttattt
6241 attatcataa aaatttacca gtctgaatag atcttgtaaa tatttgtgaa tagaatgaac
6301 actgttcata ccactgcagc cactggagat acatcctgtg gtgtcctaga agcattatcg
6361 gtaggctcta aagttttcta gactttgctg tcaactgtaa gtaattgtga tatattctac
6421 gcagtggatg gatattcttt aaatctgtgt aaatacttct gcaaaggtac tgatgctgta
6481 aagtcaaaca gttttgtgga actgtgattt tttttttcct ccttttttgg tttccttggc
6541 ccccacttgg gtttggtggg gttttgtttt tgttttgttt tgtattatac accttgtaga
6601 actcattttg ctggctgaaa gagtatggaa taatatatct catatgtcat ttttgtagaa
6661 gagaaactat ttggatttcc tttttgttgg tttggtttttc cctaacacgt gtccgctgta
6721 cgcattcgtc acgtgcaagc tcagcttgtg cagggttttt tgtatttgta aattggttta
6781 aatacatgga attttataca ggttttctcc tgtgttatat atgcattatg tgcaggtatg
6841 atatttttctt cactacttttt tctatcttaa tatagtgtgg aatttttattg tattattctt
6901 ccattcttaa tactgtacca cattcctgct cagaaactgc tcacttcctt aaattgtctt
6961 ttccccccaag cgtgaaatgt atccacttat aactgcccat tgcctgttct attagcatcc
7021 aaaaatgtgg aaggcctccc aaccaccatt tctgctgtgt ccttaggatg tgcagtaaaa
7081 aaatatagac ctgacagttt atgttataga atggcctttat ttactttggt gactgtttat
7141 agtttttaaa taaaagactg aacattttct tgagtccttt atttctgagt atgcttaaga
7201 cattctaaaa tttaaagtct agctgaaggc aaggtcaaac ggtcacctac ttactttata
7261 cttttgtgatt gtagagaaca gaaaggtgca tcatgtgata ggacaccatg gtcacggtag
7321 gaaggagacc aggagaccaa atgttttgtt tacagtagta tgagtagtag ccccagagag
7381 cgagagacag ttagggctcg gttgccttac tgtgtgtgtccc gcatctatct gactgagagc
7441 tttgtttacc attcgactct aggtttcagt ttaactaatt caggggcagc ttcttggcaa
7501 tgagcttcag tctgacagtt caaacatct tgattaattt agtaccaaaa agtaatttct
7561 ccccaggggt ccctgtgctc tcagctctaa ctgtaagaaa tgtgtggcga cacccagaac
7621 ttggtattct caggttggtg gcgtttgact tcttcgccctt agcctgggct tgcccagcag
7681 acaccctgag tccaggtacc ttactgtatc cctcaaatat cgccagacta aaggtttcta
7741 agggcagata gttgtagaaa tttatattca ctgtgtttat ctaaaaaaat tgaggttttt
7801 gaaataaattt ttgtaacatc actgtttgct tgccctcaag gtaccttttt ccttccaaag
7861 caggaaatta ccatggtggt tagcctttag tagcagaaac gacaggctta agaaagtggc
7921 ttccatagtc accatcctgt cacctcactg aattgcatcc tgtagatgta gatttttgtg
7981 ttaaaatgta taaatgtgtc tttagtgctt ttaagcaatg gtctcagcag aattttctaa
8041 atgtatctga cctgacgaaa ccaattttcta gccccccctta ggcttcccct ccggcagctt
8101 tacctgacta atggataaga cttggtgggt aacgcggttg aagtgctctt gcagtccagg
8161 gcctgcagaa ccctcgcagt cacgaaaagg tgctccttgc tagacagaaa cttgctgact
8221 tccagtattg ttatttttgt ctaaagttct gtaaatacaa gctttaatgt tatctttgag
8281 agatctatgt aaataatagt caagaacata gagactgtac aattctgtgt tatatatgtg
8341 cctagtgctc tgttggcact taataaattt taagtaacaa aactgatgat catatagtga
8401 aggcatattt ttcttccgac ttgagacagg atatgactat atattaatga gactcaataa
8461 accaagccac acatgaaaac ttgtctcatt actttatagc catgccatgt atgttttta
8521 aactataaaa tgacaataaa actgactttt gaatgagtgt tttcggataa gtgacttctg
8581 tcctgatctt ataccataaa taaagtactg aagacgaaat atgaagctct tacccaaagg
8641 agtagctgct tagaaacaag agtgaagctt aagatcagc cacacaggcc acctcacact
8701 ttgttcctgt ttatcttacg atacagtaag ggaaggcacc atttagagcc agcttgtgtt
8761 agttaaccac tctcatactg cccaactctt gactgaactc tggcactcaa atacttggag
8821 tgagcttcct tccaaggcca cagaacagag accaaccgaa ttaccagctg gttccatcat
8881 agctagtaaa ctttatctag caacaatttc cactccctgc attggtttga aaaaaaaaat
8941 gcaaagagac agtatcaatg tatgtaagtg gattcactaa taatacaacc acactttaag
9001 tattaaagtg gggtgagatg gcttggtct
```

SEQ ID NO: 12 Mouse ARID2 Amino Acid Sequence (NP_780460.3)

```
  1 manstgkapp derrkglafl delrqfhhsr gspfkkipav ggkeldlhgl ytrvttlggf
 61 akvseknqwg eiveefnfpr scsnaafalk qyylryleky kvhhfgedd devppgnpkp
121 qlpigaipss ynyqqhsvsd ylrqsyglsm dfnspndynk lvlsllsglp nevdfainvc
181 tllsneskhv mqlekdpkii tlllanagvf ddtlgsfssv fgeewrektd rdtvkfwkdi
241 vddnevrdli sdrnkahedt pgewiweslf hpprklgind ieggrvlqia vilrnlsfee
```

TABLE 1-continued

```
 301  snvkllaanr tclrflllsa hshfislrql gldtlgniaa ellldpvdfr tthlmfhtvt
 361  kclmsrdrfl kmrgmeilgn lckaedngvl iceyvdqdsy reiichltlp dvllvtstle
 421  vlymltemgd vactkiakve ksidvlvclv smdaqmfgpd alaavklieh pssshqvlse
 481  irpqaieqvq tqthiasgpa sravvaqhaa pppgiveids ekfacqwlna hfevnpdcsv
 541  sraemyseyl stcsklargg iltstgfykc lrcvfpnhtv krvedstssg qahihvigvk
 601  rralplpiqm yyqqqpistp vvrvdavadl sptpspagip hgpqaagnhf qrtpvtnqss
 661  nltarqmsfp vqgihtvaqt vsrippnpsv hthqqqnspv tviqnkapip cevvkatviq
 721  nsvpqtavpv sisvggapaq nsvgqnhsag pqpvtvvnsq tllhhpsvmp qpsplhtvvp
 781  gqvpsgtpvt viqqtvpqsr mfgrvqsipa ctstvsqgqq littspqpmh tssqqtaags
 841  qpqdtviiap pqyvttsasn ivsatsvqnt qvatgqvvti agvpspqpsr vgfqniapkp
 901  lpsqqvspsv vqqpiqqpqq paqqsvvivs qpaqqgqaya paihqivlan paalpagqtv
 961  qltgqpnitp ssspspvppt nnqvptamss sstlqsqgpp ptvsqmlsvk rqqqqqhspa
1021  apaqqvqvqv qqpqqvqvqv qpqqpsagvg qpapnessli kqlllpkrgp stpggklilp
1081  apqipppnna rapspqvvyq vannqaagfg vqgqtpaqql lvgqqnvqlv qsamppaggv
1141  qtvpisnlqi lpgplisnsp atifqgtsgn qvtitvvpnt sfaratvsgq naaqliapag
1201  lsmsgaqasa glqvqtlpag qsacttaplp fkgdkiicqk eeeakeatgl hvherkievm
1261  enpscrrgtt ntsngdtses elqvgsllng rkysdsslpp snsgklqset sqcslisngp
1321  slelgengap gkqnsepvdm qdvkgdlkka lvngicdfdk gdgshlskni pnhktsnhvg
1381  ngeispvepq gtsgatqqdt akgdqlervs ngpvltlggs pstssmqeap svatpplsgt
1441  dlpngplass lnsdvpqqrp svvvsphsta pviqghqvia vphsgprvtp salsssdarst
1501  ngtaecktvk rpaedndrdt vpgipnkvgv rivtisdpnn agcsatmvav pagadpstva
1561  kvaiesaaqq kqqhpptymq svapqntpmp pspavqvqgq psssqpspvs assqhadpvr
1621  kpgqntmclw qsckkwfqtp sqvfyhaate hggkdvypgq clwegcepfq rqrfsfithl
1681  qdkhcskdal laglkqdepg qvanqksstk qptvggtgsa praqkaiash psaalmalrr
1741  gsrnlvfrdf tdekegpitk hirltaalil knigkysecg rrllkrhenn lsvlaisnme
1801  asstlakcly elnftvqske qekdseml
```

SEQ ID NO: 13 Human BRD7 cDNA Sequence Variant 1 (NM_001173984 2. CDS: from 161 to 2119)

```
   1  gagaggggca tcgcgccgcc cggcgcgcgc cgcccccctg cctcgcggcg cggggtctcg
  61  cgggcccccgc tcccgccctc cgctcgcctg gcccggaccg gaagcggcgc cgcacggcct
 121  gggcctggcg cggggggcgg gcaccgggggc ccggtcggac atgggcaaga agcacaagaa
 181  gcacaagtcg gacaaacacc tctacgagga gtatgtgagg aagcccttga agctggtcct
 241  caaagtagga gggaacgaag tcaccgaact ctccacggcc agctcgggggc acgactccag
 301  cctcttcgaa gacaaaaacg atcatgacaa acacaaggac agaaagcgga aaaagagaaa
 361  gaaaggagag aagcagattc caggggaaga aaggggggaga aacggagaa gagttaagga
 421  ggataaaaag aagcgagatc gagaccgggt ggagaatgag cagaaaaag atctccagtg
 481  tcacgcccct gtgagattga acttgcctcc tgagaagcct ctcacaagct ctttagccaa
 541  acaagaagaa gtagaacaga cacccccttca agaagctttg aatcaactga tgagacaatt
 601  gcagagaaaa gatccaagtg ctttcttttc atttcctgtg actgattttta ttgctcctgg
 661  ctactccatg atcattaaac acccaatgga tttttagtacc atgaaagaaa agatcaagaa
 721  caatgactat cagtccatag aagaactaaa ggataacttc aaactaatgt gtactaatgc
 781  catgatttac aataaaccag agaccattta ttataaagct gcaaagaagc tgttgcactc
 841  aggaatgaaa attcttagcc aggaaagaat tcagagcctg aagcagagca tagacttcat
 901  ggctgacttg cagaaaactc gaaagcagaa agatggaaca gacacctcac agagtgggga
 961  ggacggagge tgctggcaga gagagagaa ggactctgga gatgccgaag cacacgccct
1021  caagagtccc agcaaagaaa ataaaagaa agacaaagat atgcttgaag ataagtttaa
1081  aagcaataat ttagagagag agcaggagca gcttgaccgc atcgtgaagg aatctggagg
1141  aaagctgacc aggcggcttg tgaacagtca gtgcgaattt gaaagaagaa aaccagatgg
1201  aacaacgacg ttgggactttc tccatcctgt ggatccatca gtaggagagc caggctactg
1261  ccctgtgaga ctgggaatga caactggaag acttcagtct ggagtgaata cttttgcaggg
1321  gttcaaagag gataaaagga acaaagtcac tccagtgtta tatttgaatt atgggcccta
1381  cagttcttat gcaccgcatt atgactccac atttgcaaat atcagcaagg atgattctga
1441  tttaatctat tcaacctatg gggaagactc tgatcttcca agtgatttca gcatccatga
1501  gttttttggcc acgtgccaag attatccgta tgtcatggca gatagtttac tggatgtttt
1561  aacaaaagga gggcattcca ggaccctaca agagatggag atgtcattgc ctgaagatga
1621  aggccatact aggacacttg acacagcaaa agaaatggag cagattacag aagtagagcc
1681  accagggcgt ttggactcca gtactcaaga caggctcata gcgctgaaag cagtaacaaa
1741  ttttggcgtt ccagttgaag tttttgactc tgaagaagct gaaatattcc agaagaaact
1801  tgatgagacc accagattgc tcaggggaact ccaggaagcc cagaatgaac gtttgagcac
1861  cagaccccct ccgaacatga tctgtcttct gggtccctca tacagagaaa tgcatcttgc
1921  tgaacaagtg accaataatc ttaaagaact tgcacagcaa gtaactccag tgatatcgt
1981  aagcacgtat ggagttcgaa aagcaatggg gatttccatt ccttccccccg tcatggaaaa
2041  caactttgtg gatttgacag aagacactga agaacctaaa aagacggatg ttgctgagtg
2101  tggacctggt ggaagttgag gctgcctggt atttgattat atattatgta catactttt
2161  cattcttaac ttagaaatgc ttttcagaag atattaaata tttgtaaatt gtgttttaa
2221  ttaaactttg gaacagcgaa tttgatgtt ccagaggttg gacttgtatt aggtaataaa
2281  gctggacctg ggactcgtga ggaaggaatg tgaaaaaaa aaaaaaaaa
```

SEQ ID NO: 14 Human BRD7 Amino Acid Sequence Isoform A (NP_001167455.1)

```
   1  mgkkhkkhks dkhlyeeyve kplklvlkvg gnevtelstg ssghdsslfe dkndhdkhkd
  61  rkrkkrkkge kqipgeekgr krrrvkedkk krdrdrvene aekdlqchap vrldlppekp
 121  ltsslakqee veqtplqeal nqlmrqlqrk dpsaffsfpv tdfiapgysm iikhpmdfst
 181  mkekiknndy qsieelkdnf klmctnamiy nkpetiyyka akkllhsgmk ilsqeriqsl
 241  kqsidfmadl qktrkqkdgt dtsqsgedgg cwqreredsg daeahafksp skenkkkdkd
 301  mledkfksnn lereqeqldr ivkesggklt rrlvnsqcef errkpdgttt lgllhpvdpi
 361  vgepgycpvr lgmttgrlqs gvntlqgfke dkrnkvtpvl ylnygpyssy aphydstfan
 421  iskddsdliy stygedsdlp sdfsihefla tcqdypyvma dslldvltkg ghsrtlqeme
 481  mslpedeght rtldtakeme qiteveppgr ldsscqdrli alkavtnfgv pvevfdseea
 541  eifqkkldet trllrelqea qnerlstrpp pnmicllgps yremhlaeqv tnnlkelaqq
```

TABLE 1-continued

```
    601 vtpgdivsty gvrkamgisi pspvmennfv dltedteepk ktdvaecgpg gs

SEQ ID NO: 15 Human BRD7 cDNA Sequence Variant 2 (NM_013263.4. CDS:
from 161 to 2116)
      1 gagaggggca tcgcgccgcc cggcgcgcgc cgcccccctg cctcgcggcg cggggtctcg
     61 cgggccccgc tcccgccctc cgctcgcctg gcccggaccg gaagcggcgc cgcacggcct
    121 gggcctggcg cggggggcgg gcaccggggc ccggtcggac atgggcaaga agcacaagaa
    181 gcacaagtcg acaaacacc tctacgagga gtatgtagag aagccttcga agctggtcct
    241 caaagtagga gggaacgaag tcaccgaact ctccacgggc agctcggggc acgactccag
    301 cctcttcgaa gacaaaacg atcatgacaa acacaaggac agaaagcgga aaaagagaaa
    361 gaaaggagag aagcagattc caggggaaga aaggggagaa aacggagaa gagttaagga
    421 ggataaaaag aagcgagatc gagaccgggt ggagaatgag cagaaaaag atctccagtg
    481 tcacgcccct gtgagattag acttgcctcc tgagaagcct ctcacaagct ctttagccaa
    541 acaagaagaa gtagaacaga caccccttca agaagctttg aatcaactga tgagacaatt
    601 gcagagaaaa gatccaagtg cttctttttc atttcctgtg actgatttta ttgctcctgg
    661 ctactccatg atcattaaac acccaatgga ttttagtacc atgaaagaaa agatcaagaa
    721 caatgactat cagtccatag aagaactaaa ggataacttc aaactaatgt gtactaatgc
    781 catgatttac aataaaccag agaccattta ttataaagct gcaaagaagc tgttgcactc
    841 aggaatgaaa attcttagcc aggaaagaat tcagagcctg aagcagagca tagacttcat
    901 ggctgacttg cagaaaactc gaaagcagaa agatggaaca gacacctcac agagtgggga
    961 ggacggaggc tgctggcaga gagagagaga ggactctgga gatgccgaag cacacgcctt
   1021 caagagtccc agcaaagaaa ataaaaagaa agacaaagat atgcttgaag ataagtttaa
   1081 aagcaataat ttagagagag agcaggagca gcttgaccgc atcgtgaagg aatctggagg
   1141 aaagctgacc aggcggcttg tgaacagtca gtgcgaactt gaaagaagaa aaccagatgg
   1201 aacaacgacg ttgggacttc tccatcctgt ggatcccatt gtaggagggc caggctactg
   1261 ccctgtgaga ctgggaatga caactggaag acttcagtct ggagtgaata ctttgcaggg
   1321 gttcaaagag gataaaagga acaaagtcac tccagtgtta tatttgaatt atgggcccta
   1381 cagttcttat gcaccgcatt atgactccac atttgcaaat atcagcaagg atgattctga
   1441 tttaatctat tcaacctatg gggaagactc tgatcttcca agtgatttca gcatccatga
   1501 gttttggcc acgtgccaag attatccgta tgtcatgcag gatagtttac tggatgtttt
   1561 aacaaaagga gggcattcca ggaccctaca agagatggag atgtcattgc ctgaagatga
   1621 aggccatact aggacacttg acacagcaaa agaaatggag attacagaag tagagccacc
   1681 agggcgtttg gactccagta ctcaagacag gctcatagcg ctgaaagcag taacaaattt
   1741 tggcgttcca gttgaagttt ttgactctga agaagctgaa atattccaga agaaacttga
   1801 tgagaccacc agattgctca gggaactcca ggaagcccag aatgaacgtt tgagcaccag
   1861 accccctccg aacatgatct gtcttctggg tcccccatac agagaaatgc atcttgctga
   1921 acaagtgacc aataatctta agaacttgc acagcaagta actccaggtg atatcgtaag
   1981 cacgtatgga gttcgaaaag caatggggat ttccattcct tcccccgtca tggaaaacaa
   2041 ctttgcggat ttgacagaag acactgaaga acctaaaaag acggatgttg ctgagtgtgg
   2101 acctggtgga agttgaggct gcctggtatt tgattatata ttatgtacat actttttcat
   2161 tcttaactta gaaatgcttt tcagaagata ttaaatattt gtaaattgtg ttttcaatta
   2221 aactttggaa cagcgaattt ggatgttcca gaggttgca ttgtattagg taataaagct
   2281 ggacctggga ctcgtgagga aggaatgtga aaaaaaaaa aaaaaa SEQ ID NO: 16 Human BRD7 Amino Acid Sequence Isoform B (NP_037395.2)
      1 mgkkhkhks dkhlyeeyve kplklvlkvg gnevtelstg ssghdsslfe dkndhdkhkd
     61 rkckkrkkge kqipgeekgr krrrvkedkk krdrdrvene aekdlqchap vrldlppekp
    121 ltssslakqee veqtplqeal nqlmrqlqrk dpsaffsfpv tdfiapgysm iikhpmdfst
    181 mkekiknndy qsieelkdnf klmctnamiy nkpetiyyka akkllhsgmk ilsqeriqsl
    241 kqsidfmadl qktrkqkdgt dtsqsgedgg cwqreredsg daeahafksp skenkkkdkd
    301 mledkfksnn lereqeqldr ivkesggklt rrlvnsqcef errkpdgttt lgllhpvdpi
    361 vgepgycpvr lgmttgrlqs gvntlqgfke dkrnkvtpvl ylnygpyssy aphydstfan
    421 iskddsdliy stygedsdlp sdfsihefla tcqdypyvma dslldvltkg ghsrtlqeme
    481 mslpedeght rcldtakeme iteveppgrl dsstqdrlia lkavtnfgvp vevfdseeae
    541 ifqkkldett rllrelqeaq nerlstrppp nmicllgpsy remhlaeqvt nnlkelaqqv
    601 tpgdivstyg vrkamgisip spvmennfvd ltedteepkk tdvaecgpgg s SEQ ID NO: 17 Mouse BRD7 cDNA Sequence (NM_012047.2. CDS: from 238 to
2193)
      1 ggtttgccgg cctctcgccc tctcgccact ggtgtcgcgc ttcggtcgcg tccgcgcgt
     61 ggtttttttt ttttctcgtg agggacctcg cgccgccggg ccgcgtgccgt cccctgcct
    121 cgcggcgcgg gctctcgcgg ccccgctcc cgccctccgc tgcctggcc cggaccggaa
    181 gcggcgccgc acggcctggg cctggcgcgg ggggcccgg ctggggcccg gtcggacatg
    241 ggcaagaagc acaagaagca caagtcggac cgccacttct acgaggagta cgtggagaag
    301 cccctgaagc tggtcctcaa agtcgggggg agcgaggtca ccgagctctc cacgggcagc
    361 tccgggcacg actccagcct cttcgaagac agaagcgacc agacaaaca caaggacaga
    421 aaacggaaaa agaggaagaa aggcgagaag caggctccgg gggaagaga ggggagaaaa
    481 cggagaagag tcaaggagga taaaagaag cgggatcgag accgtgcaga gaatgaggtg
    541 gacagagatc tccagtgtca tgtccctata agattagact tacctcctga gaagcctctt
    601 acaagctcgt tagccaaaca agaagaagta gaacagacac cccttcagga agctttgaat
    661 cagctcatga gacaattgca aagaaaagac tccaagtgtt ctttttcatt tcctgtgacg
    721 gattttattg cgcctggcta ctccatgatt attaaacacc caatggattt tagtaccatg
    781 aaagaaaaga tcaagaataa cgactaccag tccatagaag aactaaagga taacttcaag
    841 ctaatgtgta ctaatgcaat gatttacaat aagccagaga ccatttatta taaagctgca
    901 aagaagctgt tgcactcagg gatgaaaatt ctcagtcagg agatttca agcagaaaga
    961 cagagtatag acttcatgtc agacttgcag aaaactcgga agcagaaaga cgaacagat
   1021 gcctgtcaga gtggggagga cagcggctgc tggcagcgcg agggaagaa ctctggagat
   1081 gctgaaacac aggccttcag aagcccgct aaggacaata aaggaaaga caaagatgtg
   1141 cttgaagaca aatggagaag cagcaactca gaaagggagc atgagcagat tgagcgcgtt
   1201 gtccaggagt caggaggcaa gctaacacgg cggctggcaa acagtcagtg tgaatttgaa
```

TABLE 1-continued

```
1261 agaagaaaac cagatgggac aacaacactg gggcttctcc atcctgtgga tcccattgtg
1321 ggagagccag gctactgccc tgtgagattg gggatgacaa ctggaagact gcagtctgga
1381 gtgaacactc tgcaggggtt caaagaggat aaaaggaaca gagtaacccc agtattatac
1441 ttgaattatg gaccctacag ttcttatgcc ccacattatg actctacatt tgccaatatt
1501 agcaaagatg attctgattt aatctactca acatatgggg aagactctga ccttccaaac
1561 aatttcagca tctctgagtt tttggccaca tgccaagatt acccgtatgt tatggcagat
1621 agtttactgg atgttctaac aaaaggagga cattccagga gcctgcagga cttggacatg
1681 tcatctcctg aagatgaagg ccagaccaga gcattggaca cagcaaaaga agcagagatt
1741 acacaaatag agccaacagg gcgtttggag tccagcagtc aggacagctc cacagcactg
1801 caagctgtaa aaccctttgg tgctccagct gaagtctttg actccgaaga ggctgaggtg
1861 ttccagagga agcttgatga gacgcaagat tgctcaggg agctccagga ggcacagaat
1921 gagcgactga gcactaggcc tcctcccaat atgatctgtc tcctgggtcc ttcttacaga
1981 gaaatgtacc ttgctgaaca agtgaccaat aacctcaaag aactcacaca gcaagtgact
2041 ccaggtgatg ttgtaagcat acacggagtg cgaaaagcaa tggggatttc tgttccttcc
2101 cccatcgtgg gaaacagctt cgtagatttg acaggagagt gtgaagaacc taaggagacc
2161 agcactgctg agtgtgggcc tgacgcgagc tgaactagcc tggtatttga ttctattatg
2221 tacatagttt tcattctga acttggaggt gcttttcaga agatattaac tatttgtaaa
2281 ttgtgttttta attaagcttt gggacagttc ctttcaatgt tccaaagatt ggctttgtat
2341 taggaaataa agctgaacct gggactgtga
```

SEQ ID NO: 18 Mouse BRD7 Amino Acid Sequence (NP_036177.1)
```
  1 mgkkhkhhks drhfyeeyve kplklvlvkg gsevtelstg ssghdsslfe drsdhdkhkd
 61 rkrkkrkkge kqapgeekgr krrrvkedkk krdrdraene vdrdlqchvp irldlppekp
121 ltsslakqee veqtplqeal nqlmrqlqrk dpsaffsfpv tdfiapgysm iikhpmdfst
181 mkekiknndy qsieelkdnf klmctnamiy nkpetiyyka akkllhsgmk ilsqeriqsl
241 kqsidfmsdl qktrkqkert dacqsgedsg cwqreredsg daetqafrsp akdnkrkdkd
301 vledkwrssn serehegier vvqesggklt rrlansqcef errkpdgttt lgllhpvdpi
361 vgepgycpvr lgmttgrlqs gvntlqgfke dkrnvtpvl ylnygpyssy aphydstfan
421 iskddsdliy stygedsdlp nnfsisefla tcqdypyvma dslldvltkg ghsrslqdld
481 msspedegqt raldtakeae itqieptgrl esssqdrlta lqavttfgap aevfdseeae
541 vfqrkldett rllrelqeaq nerlstrppp nmicllgpsy remylaeqvt nnlkeltqqv
601 tpgdvvsihg vrkamgisvp spivgnsfvd ltgeceepke tstaecgpda s
```

SEQ ID NO: 19 Human PHF10 cDNA Sequence Variant 1 (NM_018288.3, CDS: from 80 to 1576)
```
  1 ggcggcggcg gcagcggcgg cggcggccgg acaaggcgg aggcgacggc ggcggcggcg
 61 gcgcggggcg cccgggctga tggcggcggc ggccgggccc ggggctgcgc tgtccccgcg
121 gccgtgcgac agcgacccag ccaccccgg acgcagtcg ccgaaggatg ataatgaaga
181 taattcaaat gatgggaccc agccatccaa aaggaggcga atgggctcag gagatagttc
241 taggagttgt gaaacttcaa gtcaagatct tggttttagt tactatccag cagaaaactt
301 gatagagtac aaatggccac ctgatgaaac aggagaatac tatatgcttc aagaacaagt
361 cagtgaatat tgggtgtga cctcctttaa aaggaaatat ccagatttag agcgacgaga
421 tttgtctcac aaggagaaac tctacctgag agagctaaat gtcattactg aaactcagtg
481 cactctaggc ttaacagcat tgcgcagtga tgaagtgatt gatttaatga taaaagaata
541 tccagccaaa catgctgagt attctgttat tctacaagaa aagaacgtc aacgaattac
601 agaccattat aaagagtatt cccaaatgca aacagaat actcagaaag ttgaagccaa
661 taaagtgcct gagtatatta agaaagctgc caaaaaagca gcagaattta atagcaacct
721 aaaccgggaa cgcatggaag aaagaagagc ttatttgac ttgcagacac atgttatcca
781 ggtacctcaa gggaagtaca agttttgcc aacagagcga acaaaggtca gtccttaccc
841 agtggctctc atccccggac agttccagga atattataag aggtactcac cagatgagct
901 gcggtatctg ccattaaaca cagccctgta tgagcccct ctggatcctg agctccctgc
961 tctagacagt gatggtgatt cagatgatgg cgaagatggt cgaggtgatg agaacggaa
1021 aaataaaggc acttcggaca gctcctctgg caatgtatct gaagggggaaa gccctcctga
1081 cagccaggag gactcttttc agggaagaca gaaatcaaaa gacaaagctg ccactccaag
1141 aaaagatggt cccaaacgtt ctgtactgtc caagtcagtt cctgggtaca gcccaaaggt
1201 cattccaaat gctatatgtg gaattgtct gaagggtaag gagtccaaca agaaaggaaa
1261 ggctgaatca cttatacact gctcccaatg tgagaatagt ggccatcctt cttgcctgga
1321 tacgcacatg gagcttgttt ctatgattaa gacctaccca tggcagcgta tggaatgtaa
1381 aacatgcatt atatgtggac aacccccacca tgaagaagaa atgatgttct gtgatatgtg
1441 tgacagaggt tatcatactt tttgtgtggg ccttggtgct attccatcag gtcgctggat
1501 ttgtgactgt tgtcagcggg ccccccaac acccaggaaa gtgggcagaa ggggaaaaa
1561 cagcaaagag ggataaaata gttttgact caatactgt atatgcattt aagtggaata
1621 tttggtgcca tttacaacat tattttcatg ccaataaag atttttttg caaaaaaaaa
1681 aaaaaaaa aa
```

SEQ ID NO: 20 Human PHF10 Amino Acid Sequence Isoform A (NP_060758.2)
```
  1 maaaagpgaa lsprpcdsdp atpgaqspkd dnednsndgt qpskrrrmgs dssrscets
 61 sqdlgtsyyp aenlieykwp pdetgeyyml qeqvseylgv tsfkrkypdl errdlshkek
121 lylrelnvit ecqctlglta lrsdevidlm ikeypakhae ysvilqeker qritdhykey
181 sqmqqqntqk veaskvpeyi kkaakkaaef nsnlnrerme errayfdlqt hviqvpqgky
241 kvlptertkv ssypvalipg qfqeyykrys pdelrylpln talyeppldp elpaldsdgd
301 sddgedgrgd ekrknkgtsd sssgnvsege spdsqedsf qgrqkskdka atprkdgpkr
361 svlsksvpgy kpkvipnaic giclkgkesn kkgkaeslih csqcensghp scldmtmelv
421 smiktypwqc mecktciicg qphheeemmf cdmcdrgyht fcvglgaips grwicdccqr
481 apptprkvgr rgknskeg
```

SEQ ID NO; 21 Human PHF10 cDNA Sequence Variant 2 (NM_133325.2. CDS: From 80 to 1570)
```
  1 ggcggcggcg gcagcggcgg cggcggccgg acaaggcgg aggcgacggc ggcggcggcg
 61 gcgcggggcg cccgggctga tggcggcggc ggccgggccc ggggctgcgc tgtccccgcg
```

TABLE 1-continued

```
 121 gccgtgcgac agcgacccag ccaccccggg agcgcagtcc ccgaaggatg ataatgaaga
 181 taattcaaat gatgggaccc agccatccaa aaggaggcga atgggctcag gagatagttc
 241 taggagttgt gaaacttcaa gtcaagatct tggttttagt tactatccag cagaaaactt
 301 gatagagtac aaatggccac ctgatgaaac aggagaatac tatatgcttc aagaacaagt
 361 cagtgaatat ttgggtgtga cctcctttaa aaggaaatat ccagagcgac gagatttgtc
 421 tcacaaggag aaactctacc tgagagagct aaatgtcatt actgaaactc agtgcactct
 481 aggcttaaca gcattgcgca gtgatgaagt gattgattta atgataaaag aatatccagc
 541 caaacatgct gagtattctg ttattctaca agaaaaagaa cgtcaacgaa ttacagacca
 601 ttataaagag tattcccaaa tgcaacaaca gaatactcag aaagttgaag ccagtaaagt
 661 gcctgagtat attaagaaag ctgccaaaaa agcagcagaa tttaatagca acttaaaccg
 721 ggaacgcatg gaagaaagaa gagcttattt tgacttgcag acacatgtta tccaggtacc
 781 tcaagggaag tacaaagttt gccaacagag cgaacaaag gtcagttctt acccagtggc
 841 tctcatcccc ggacagttcc aggaatatta taagaggtac tcaccagatg agctgcggta
 901 tctgccatta aacacagccc tgtatgagcc ccctctggat cctgagctcc ctgctctaga
 961 cagtgatggt gattcagatg atggcgaaga tggtcgaggt gatgagaaac ggaaaaataa
1021 aggcacttcg gacagctccc ctggcaatgt atctgaaggg gaaagccccc ctgacagcca
1081 ggaggactct ttccagggaa gacagaaatc aaaagacaaa gctgccactc caagaaaaga
1141 tggtcccaaa cgttctgtac tgtccaagtc agttcctggg tacaagccaa aggtcattcc
1201 aaatgctata tgtggaattt gtctgaaggg taaggagtcc aacaagaaag gaaaggctga
1261 atcacttata cactgctccc aatgtgagaa tagtggccat ccttctcgcc tggatatgac
1321 aatggagctt gttttctatga ttaagaccta cccatgcagg tgtatgaat gtaaaacatg
1381 cattatatgt ggacaacccc accatgaaga gaaatgatg ttctgtgata tgtgtgacag
1441 aggttatcat acttttgtg tgggccttgg tgctattcca tcaggtcgct ggatttgtga
1501 ctgttgtcag cgggcccccc caacacccag gaaagtgggc agaaggggga aaaacagcaa
1561 agagggataa aatagttttt gactctaata ctgtatatgc atttaagtgg aatatttggt
1621 gccatttaca acattatttt catgccaata aaagattttt tttgcaaaaa aaaaaaaaaa
1681 aaaaaa
```

SEQ ID NO: 22 Human PHF10 Amino Acid Sequence Isoform B (NP_579866.2)
```
   1 maaaagpgaa lsprpcdsdp atpgaqspkd dnednsndgt qpskrrrmgs gdssrscets
  61 sqdlgfsyyp aenlieykwp pdetgeyyml qeqvseylgv tsfkrkyper rdlshkekly
 121 lrelnvitet qctlgltalr sdevidlmik eypakhaeys vilqekerqr itdhykeysq
 181 mqqqntqkve askvpeyikk aakkaaefns nlnrermeer rayfdlqthv iqvpqgkykv
 241 lptertkvss ypvalipgqg qeyykryspd elrylplnta lyeppldpel paldsdgds
 301 dgedgrgdek rknkgtsdss sgnvsegesp pdsqedsfqg rqkskdkaat prkdgpkrsv
 361 lsksvpgykp kvipnaicgi clkgkesnkk gkaeslihcs qcensghpsc ldmtmelvsm
 421 iktypwqcme cktciicgqp hheeemmfcd mcdrgyhtfc vglgaipsgr wicdccqrap
 481 ptprkvgrrg knskeg
```

SEQ ID NO: 23 Mouse PHF10 cDNA Sequence (NM_024250.4. CDS: from 67 to 1560)
```
   1 gcggcggcgg ccgctgggac taggcgaagg cggcgacgac gacggaggcg cggggcgctt
  61 gggctgatgg cagcggccgg gccgggggcg gcgctgtccc cggggcggtg cgacagcgac
 121 ccggcctccc ccggagcgca gtccccaaag gatgataatg aagacaactc aaatgatggg
 181 acccatccat gtaaaggag gcgaatgggc tcaggagaca gctcaagaag ttgtgagact
 241 tcaagtcaag atcttagctt cagttactac ccagcagaaa acttaatcga atacaaatgg
 301 ccacctgatg aaacaggaga atactatatg cttcaggagc aagtcagtga atatctgggt
 361 gtgacctcct tcaagcggaa atatccagat ttagagcgac gagatttatc tcacaaggag
 421 aaactatacc tgagagaatt aaacgtcatc acggaaacac agtgcacact gggtttaaca
 481 gcattgcgca gtgatgaagt gattgactta tgataaaag aatatccagc tacacacgct
 541 gaatattcgg ttatcctaca agaaaaggaa cgtcagagaa ttacagatca ttataaagag
 601 tattctcaaa tgcaacaaca gagtactcag aaagtcgaag ccagcaaagt acctgagtac
 661 attaagaaag cagccaagaa ggcagctgag ttcaacagca acttaaaccg ggagcgcatg
 721 gaagaaagaa gagcctattt tgacttacag acacatgtta tccaagtgcc tcaaggaaga
 781 tacaaagtgt tgccgacaga ccgaacgaag gtcagttcct acccagtggc tctcatcccg
 841 ggacagttcc aggagtatta taagaggtac tcaccagatg agcttcggta cttgccatta
 901 aacacagccc tgtatgagcc gccctggac ccagagctcc cggcactaga tagtgatgga
 961 gactcagatg atggcgaaga tggcggaggg gatgagaagc ggaagaataa aggcacttcg
1021 gacagctcct caggcaatgt gtctgaagga gacccccc ctgacagcca ggaggacacc
1081 ttccacggaa gacagaaatc aaaagacaaa atggccactc caagaaaaga cggctccaaa
1141 cgttctgtac tgtccaaatc agcccctggg tacaagccaa aggtcattcc aaatgctcta
1201 tgtggaattt gtctgaaggg taaggagtcc aacaagaaag gaaaggctga atcacttata
1261 cactgctccc agtgtgataa cagtggccac ccttcttgct tggatatgac cttggagctt
1321 gtttctatga ttaagaccta cccatggcag tgtatggaat gtaagacatg cattatatgt
1381 ggacagcccc accatgaaga gaaatgatg ttctgtgatg tgtgtgacag aggttatcat
1441 actttttgtg tgggccttgg tgctattcct tcaggtcgct ggatttgtga ctgttgtcag
1501 cgagctcccc caacacccag gaaagtgggc agaaggggaa aacagcaa agagggggtaa
1561 aataggcttt gaccctcatg tttgggatat tggtgccaa tttatttaca acactttcat
1621 ttttacgcca ataaaaactt tttcgaaatt aacgatgacc ttaaa
```

SEQ ID NO: 24 Mouse PHF10 Amino Acid Sequence (NP_077212.3)
```
   1 maaagpgaal spgrcdsdpa spgaqspkdd nednsndgth pckrrrmgsg dssrscetss
  61 qdlsfsyypa enlieykwpp detgeyymlq eqvseylgvt sfkrkypdle rrdlshkekl
 121 ylrelnvite tqctlgltal rsdevidlmi keypakhaey svilqekerq ritdhykeys
 181 qmqqqstqkv easkvpeyik kaakkaaefn snlnrermee rrayfdlqrh viqvpqgkyk
 241 vlptdrtkvs sypvalipgq fqeyykrysp delrylplnt alyeppldpe lpaldsdgds
 301 ddgedgggde krknkgtsds ssgnvsegds ppdsqedtfh grqkskdkma tprkdgskrs
 361 vlsksapgyk pkvipnalcg iclkgkesnk kgkaeslihc sqcdnsghps cldmtmelvs
 421 miktypwqcm ecktciicgq phheeemmfc dvcdrgyhtf cvglgaipsg rwicdccqra
 481 pptprkvgrr gknskeg
```

TABLE 1-continued

SEQ ID NO: 25 Human KDM6A cDNA Sequence
```
   1 atgaaatcct gcggagtgtc gctcgctacc gccgccgctg ccgccgccgc tttcggtgat
  61 gaggaaaaga aaatggcggc gggaaaagcg agcggcgaga gcgaggaggc gtccccagc
 121 ctgacagccg aggagaggga ggcgctcggc ggactgacag gccgcctctt tgggttcgtg
 181 agatttcatg aagatggcgc caggacgaag gccctactgg gcaaggctgt tcgctgctat
 241 gaatctctaa tcttaaaagc tgaaggaaaa gtggagtctg atttcttttg tcaattaggt
 301 cacttcaacc tcttattgga agattatcca aaagcattat ctgcatacca gaggtactac
 361 agtttacagt ctgactactg gaagaatgct gccttttat atggtcttgg tttggtctac
 421 ttccattata atgcatttca gtgggcaatt aaagcatttc aggaggtgct ttatgttgat
 481 cccagctttt gtcgagccaa ggaaattcat ttcgacttg gcttatgtt caaagtgaac
 541 acagactatg agtctagttt aaagcatttt cagttagctt tggttgactg taatccctgc
 601 actttgtcca atgctgaaat tcaatttcac attgcccact tatatgaaac ccagaggaaa
 661 tatcattctg caaaagaagc ttatgaacaa cttttgcaga cagagaatct ttctgcacaa
 721 gtaaaagcaa ctgtcttaca acagttaggt tggatgcatc acactgtaga tctcctggga
 781 gataaagcca ccaaggaaag ctatgctatt cagtatctcc aaaagtcctt ggaagcagat
 841 cctaattctg gccagtcctg gtatttcctc ggaaggtgct attcaagtat tgggaaagtt
 901 caggatgcct ttatatctta caggcagtct actgataaat cagaagcaag tgcagataca
 961 tggtgttcaa taggtgtgct atatcagcag caaaatcagc ccatggatgc tttacaggcc
1021 tatatttgtg ctgtacaatt ggaccatggc catgctgcag cctggatgga cctaggcact
1081 ctctatgaat cctgcaacca gcctcaggat gccattaaat gctacttaaa tgcaactaga
1141 agcaaaagtt gtagtaatac ctctgcactt gcagcacgaa ttaagtattt acaggctcag
1201 ttgtgtaacc ttccacaagg tagtctacag aataaaacta aattacttcc tagtattgag
1261 gaggcgtgga gcctaccaat tcccgcagag cttacctcca ggcagggtgc catgaacaca
1321 gcacagcaga atacttctga caattggagt gggtggacatg ctgtgtcaca tcctccagta
1381 cagcaacaag ctcattcatg tgtttgaca ccacagaaat tacagcattt ggaacagctc
1441 cgcgcaaata gaaataattt aaatccagca cagaaactga tgctggaaca gctggaaagt
1501 cagtttgtct taatgcaaca acaccaaatg agaccaacag gagttgcaca ggtacgatgt
1561 actggaattc ctaatgggcc aacagctgac tcatcactgc ctacaaactc agtctctggc
1621 cagcagccac agcttgctct gaccagagtg cctagcgtct ctcagcctgg agtccgtcct
1681 gcctgccctg gcagccttt ggccaatgga ccctttcctg caggccatgt tccctgtagc
1741 acatcaagaa cgctgggaag tacagacact attttgatag caataatca tataacagga
1801 agtggaagta atggaaacgt gccttacctg cagcgaaacg cactcactct acctcataac
1861 cgcacaaaac tgaccagcag cgcagaggag ccgtggaaaa accaactatc taactccact
1921 cagggcttc acaaaggtca gagttcacat tcggcagctc ctaatggtga acgacctctc
1981 tcttccactg ggccttccca gcatcccag gcagctggct ctggtattca gaatcagaac
2041 ggacatccca ccctgcctag caattcagta acacaggggg ctgctctcaa tcacctctcc
2101 tctccactg ctacctcagg tggacaacaa gcattacct taaccaaaga gagcaagcct
2161 tcaggaaaca tattgacggt gcctgaaaca agcaggcaca ctggagagac acctaacagc
2221 actgccagtg tcgagggact tcctaatcat gtccatcaga tgacggcaga tgctgtttgc
2281 agtcctagcc atggagattc taagtcacca ggtttactaa gttcagacaa tcctcagctc
2341 tctgccttgt tgatgggaaa agccaataac aatgtgggta tggggactg tgacaaagtc
2401 aataacatcc acccagctgt tcatcaaaag actgataact ctgttgcctc ttcaccatct
2461 tcagcccttt caacagcaac accttctcca aaatccactg agcagacaac cacaaacagt
2521 gttaccagcc ttaacagccc tcacagtggg ctacacacaa ttaatggaga agggatggaa
2581 gaatctcaga gccccatgaa aacagatctg cttctggtta accacaaacc tagtccacag
2641 atcataccat caatgtctgt gtccatatac cccagctcag cagaagttct gaaggcatgc
2701 aggaatctag gtaaaaatgg cttatctaac agtagcattt tgttggataa atgtccacct
2761 ccaagaccac catcttcacc ataccctccc ttgccaaagg acaagttgaa tccacctaca
2821 cctagtattt acttggaaaa taaacgtgat gctttcttc ctccattaca tcaatttgt
2881 acaaatccga acaaccctgt tacagtaata cgtggccttg ctggagctct taagttagac
2941 ctgggacttt tctctactaa aactttggcg gaagctaaca atgaacatat ggtagaagtg
3001 aggacacagt tgttgcagcc agcagatgaa aactgggatc ccactggaac aagaaaatc
3061 tggcattgtg aaagtaatag atctcatact caaattgtca aatatgcaca gtaccaggcc
3121 tcctcattcc aggaatcatt gagagaagaa atgaaaaaa gaagtcatca taaagaccac
3181 tcagatagtg aatctacatc gtcagataat ctgggaggag ggaggaaagg accctttaaa
3241 accataaagt ttgggaccaa tattgaccta tctgatgaca aaaagtggaa gttgcagcta
3301 catgagctga ctaaacttcc tgcttttgtg cgtgtcgtat cagcaggaaa tcttctaagc
3361 catgttggtc ataccatatt gggcatgaac acagttcaac tatacatgaa agttccaggg
3421 agcagaacac caggtcatca ggaaaataac aacttctgtt cagttaacat aaatattggc
3481 ccaggtgact gcgaatggtt tgttgttcct gaaggttact ggggtgttct gaatgacttc
3541 tgtgaaaaaa ataatttgaa tttcctaatg ggttcttggt ggcccaatct tgaagatctt
3601 tatgaagcaa atgttccagt gtataggttt attcagcgac ctggagattt ggtctggata
3661 aatgcaggca ctgttcattg ggttcaggct attggctggt gcaacaacat tgcttggaat
3721 gttggtccac ttacagcctg ccagtataaa ttggcagtgg aacggtacga atggaacaaa
3781 ttgcaaagtg tgaagtcaat agtacccatg gttcatcttt cctggaatat ggcacgaaat
3841 atcaaggtct cagatccaaa gctttctgaa atgattaagt tggcagtggt aagaactgtg
3901 aagcaatgtc agacattgag ggaagctctc actgctgcag aaaagagat tatatggcat
3961 gggcggacaa agaagaaacc agctcattac tgtagcattc gtgaagtgga ggttttttgat
4021 ctgcttttg tcactaatga gagtaattca cgaaagacct acatagtaca ttgccaagat
4081 tgtgcacgaa aaacaagcgg aaacttggaa aactttgtgg tgctagaaca gtacaaaatg
4141 gaggacctga tgcaagtcta tgaccaattt acattagctc ctccattacc atccgcctca
4201 tcttga
```

SEQ ID NO: 26 Human KDM6A Amino Acid Sequence
```
   1 mkscgvslat aaaaaaafgd eekkmaagka sgeseeasps ltaeerealg gldsrlfgfv
  61 rfhedgartk allgkavrcy eslilkaegk vesdffcqlg hfnllledyp kalsayqryy
 121 slqsdywkna aflyglglvy fhynafqwai kafqevlyvd psfcrakeih lrlglmfkvn
 181 tdyesslkhf qlalvdcnpc tlsnaeiqfh iahlyetqrk yhsakeayeq llqtenlsaq
 241 vkatvlqqlg wmhhtvdllg dkatkesyai qylqkslead pnsgqswyfl grcyssigkv
```

TABLE 1-continued

```
 301 qdafisyrqs idkseasadt wcsigvlyqq qnqpmdalqa yicavqldhg haaawmdlgt
 361 lyescnqpqd aikcylnatr skscsntsal aarikylqaq lcnlpqgslq nktkllpsie
 421 eawslpipae ltsrqgamnt aqqntsdnws gghavshppv qqqahswclt pqklqhleql
 481 ranrnnlnpa qklmleqles qfvlmqqhqm rptgvaqvrs tgipngptad ssllptnsvsg
 541 qqpqlaltrv psvsqpgvrp acpgqplang pfsaghvpcs tsrtlgstdt ilignnhitg
 601 sgsngnvpyl qrnaltlphn rtnltssaee pwknqlsnst qglhkgqssh sagpngerpl
 661 sstgpsqhlq aagsgiqnqn ghptlpsnsv tqgaalnhls shtatsggqq gitltkeskp
 721 sgniltvpet srhtgetpns tasveglpnh vhqmtadavc spshgdsksp gllssdnpql
 781 sallmgkann nvgtgtcdkv nnihpavhtk tdnsvassps saistatpsp ksteqtttns
 841 vtslnsphsg lhtingegme esqspmktdl llvnhkpspq iipsmsvsiy pssaevlkac
 901 rnlgknglsn ssilldkcpp prppsspypp lpkdklnppt psiylenkrd affpplhqfc
 961 tnpnnpvtvi rglagalkld lglfstktlv eannehmvev rtqllqpade nwdptgtkki
1021 whcesnrsht tiakyaqyqa ssfqeslree nekrshhkdh sdsestssdn sgrrrkgpfk
1081 tikfgtnidl sddkkwklql heltklpafv rvvsagnlls hvghtilgmn tvqlymkvpg
1141 srtpghqenn nfcsvninig pgdcewfvvp egywgvlndf ceknnlnflm gswwpnledl
1201 yeanvpvyrf iqrpgdlvwi nagtvhwvqa igwcnniawn vgpltacqyk laveryewnk
1261 lqsvksivpm vhlswnmarn ikvsdpklfe mikycllrtl kqcqtlreal iaagkeiiwh
1321 grtkeepahy csicevevfd llfvtnesns rktyivhcqd carktsgnle nfvvleqykm
1381 edlmqvydqf tlapplpsas s SEQ ID NO: 27 Mouse KDM6A cDNA Sequence
   1 atgaaatcct gcggagtgtc gctcgctacc gccgccgccg ccgccgccgc cgccgctttc
  61 ggtgatgagg aaaagaaaat ggcggcggga aaagcgagcg gcgagagcga ggaggcgtcc
 121 cccagcctga cagcggagga gagggaggcg ctcggcggac tggacagccg cctttctcgggg
 181 ttcgtgaggt ttcatgaaga tggcgccagg atgaaggccc tgctgggcaa ggctgttcgc
 241 tgctacgaat ctctaatcct aaaagctgaa gggaaagtga agtctgattt cttttgtcaa
 301 ttaggtcact tcaacctctt attggaagat tatccaaaag cattatctgc ataccagagg
 361 tactacagtt tacagtctga ttactggaag aatgctgcct ttttatatgg tcttggtttg
 421 gtctacttcc attacaatgc atttcagtgg gctattaaag cattcagga ggtgcttat
 481 gtcgatccca gcttttgtcg agccaaggaa attcatttac gacttgggct tatgttcaaa
 541 gtgaacacag actatgagtc tagtttaaag catttcagt tagctttggt tgactgtaat
 601 ccctgcactt tgtccaatgc tgaaattcag tttcacattg cccacttata tgaaacccag
 661 aggaagtatc attctgcaaa agaagcttat gagcaacttt tgcagacaga aaacctttct
 721 gcacaagtaa aagcaactat tttacaacaa ttaggctgga tgcatcacac tgtggatctc
 781 ctgggagata aggccaccaa ggaaagttat gctattcagt atctccagaa gtccttggaa
 841 gcagatccaa attctggcca gtcctggtat ttccttgaa ggtgctattc aagtattggg
 901 aaagttcagg atgccttat atcttacagg caatctattg ataaatcaga agcaagtgca
 961 gatacatggt gttcaatagg tgtgctctat caacagcaaa atcagcctat ggctgctttg
1021 caagcttata tttgtgctgt acaattggac cacggtcatg ctgcagcccg gatggatcca
1081 ggcactctct atgaatcctg caaccaacct caggatgcta tcaaatgcta tttaaatgca
1141 actagaagca aaaattgtag taataacctct ggacttgcag cacgaattaa gtatttacag
1201 gctcagttgt gtaacctttcc acaaggtagt ctacagatata aaactaaatt acttcctagt
1261 attgaggagg cacggagcct accaatccc gcagagctta ccccaggca gggtgccatg
1321 aacacagcac agcagaaatc tccgataat tggagtggtg gcaatgcacc acctccagta
1381 gaacaacaaa ctcattcatg gtgtttgaca ccacagaaat tacagcactt ggaacagctc
1441 cgagcaaaca gaaataattt aaatccagca gaaaactaa tgctggaaca gctggaaagt
1501 cagtttgtct taatgcagca acaccaaatg agacaaacag gagttgcaca ggtacggcct
1561 actggaattc ttaatgggcc aacagttgac tcatcaccgc tacaaactcc agtttctggc
1621 cagcagccac agcttcctct gaccagaatg cctagtgtct ctcagcctgg agtccacact
1681 gcctgcccta gcagactttt ggcaatgga ccctttttctg caggccatgt tccctgtagc
1741 acatcaagaa cactgggaag tacagacact gttttgatag gcaataatca tgtaacagga
1801 agtggaagta atggaaacgt gccttacctg cagcgaaacg cacccactct acctcataac
1861 cgcacaaacc tgaccagcag cacagaggag ccgtggaaaa accaactatc taactccact
1921 cagggggcttc acaaaggtcc gagttcacat ttggcaggtc ccaatggtca acgacctcta
1981 tcttccactg ggccttccca gcatctccag gcagctggct ctggtattca gaatcagaat
2041 ggacatccca ccctgcctag caattcagta acacagggg ctgctctcaa tcacctctcc
2101 tctcacactg ctacctcagg tggacaacaa ggcattacct taaccaaaga gagcaagcct
2161 tcaggaaaca cattgacggt gcctgaaaca agcaggcaaa ctggagagac cctaacagc
2221 actgccagtg ttgagggact tcctaatcat gtccatcagc tgatggcaga tgctgtttgc
2281 agtcctagcc atggagattc taagtcacca ggtttactaa gttcagacaa tcctcagctc
2341 tctgccttgt tgatgggaaa agctaataac aatgtgggtc tggaacctg tgacaaagtc
2401 aataacatcc acccaactgt ccatacaaag actgataatt ctgttgcctc ttcaccatct
2461 tcagccattt ccacagcaac acccttctcct aagtccactg aacagacaac caaaacagt
2521 gttaccagcc ttaacgccc tcacagtggg ctgcacacaa ttaatggaga aggaatgaa
2581 gaatctcaga gccccattaa aacagatctg cttctagtta gccacagacc tagtcctcag
2641 atcataccat caatgtctgt gtccatatat cccagctcag cagaagttct gaaagcttgc
2701 aggaatctag gtaaaaacgt cctgtctaat agtagcattc tgttggataa atgtccgcct
2761 ccaagaccac catcctcacc atacctcccc ttgccaaagg acaagttgaa tccacctaca
2821 cctagtattt attggaaaa taacgtgat gctttcttc ctccattaca tcaattttgt
2881 acaaacccaa acaacccctgt tacagtaata cgtggccttg ccggagctct taaattagac
2941 ttgggactt tctctactaa aactttggtg gaagctaaca atgaacatat ggtagaagtg
3001 aggacacagt tgttacaacc agcagatgaa aattgggacc tactggaac caagaaaatc
3061 tggcactgtg aaagtaatag atctcatact acaattgcta aatatgctca gtaccaggcc
3121 tcctcattcc aagaatcatt gagagaagaa atgagaaaa gaagtcacca taagaccac
3181 tcagacagtg aatctacatc atcagataat tctgttggaa gaagaaagg acccttttaaa
3241 accattaagt ttgggaccaa cattgacctg tccgatgaca aaaagtggaa gttacagcta
3301 catgagctga ctaaacttcc tgccttcgtg agagtttgtat ctgcaggaaa tctttaagc
3361 cacgttggtc atactatact gggcatgaac acagttcaac tatacatgaa agttccagga
3421 agcagaacac caggtcatca agaaaataac aacttctgtt cagtaatat aaatattggc
3481 ccaggtgact gtgaatggtt tgttgttcct gaaggctact ggggtgtttt gaatgacttc
```

TABLE 1-continued

```
3541 tgtgaaaaaa ataatttgaa tttcttaatg ggttcttggt ggcccaacct tgaagatcta
3601 tatgaagcaa atgttccagt gtataggttt attcagcgac ctggagatct ggtctggata
3661 aatgctggca ctgttcattg ggttcaagct attggctggt gcaacaacat tgcttggaat
3721 gttggtccac ttacagcctg tcagtataag ttagcagcgg aacgttatga atggaacaag
3781 ttgcaaaatg taaagtcaat agtacccatg gttcatcttt cctggaatat ggcacgaaat
3841 atcaaggttt cagatccaaa gctttttgaa atgattaagt attgtcttct gagaacgctg
3901 aagcaatgtc agacattgag ggaagctcta attgctgcag aaaagagat catatggcac
3961 gggcggacaa aagaagaacc agctcattat tgtagtattt gtgaggtgga ggttttgat
4021 ctgctctttg tcactaatga gagcaattct cgaaaaacct acatagtaca ttgccaagat
4081 tgtgcacgaa aaacaagtgg gaatctggaa aattttgcgg tgctagaaca gtacaaaatg
4141 gaggatctga tgcaagtcta tgaccaattt acattagtaa gtgaaatcaa catgctcctc
4201 cattaccatc cgcctcatct tgatattgtt ccatggacat taaacatgag accttttctg
4261 ctattcagaa agtaa
```

SEQ ID NO: 28 Mouse KDM6A Amino Acid Seauence

```
   1 mkscgvslat aaaaaaaaaf gdeekkmaag kasgeseeas psltaeerea lgggldsrlfg
  61 fvrfhedgar mkallgkavr cyeslilkae gkvesdffcq lghfnllled ypkalsayqr
 121 yyslqsdywk naaflyglgl vyfhynafqw aikafqevly vdpsfcrake ihlrlglmfk
 181 vntdyesslk hfqlalvdcn pctlsnaeiq fhiahlyetq rkyhsakeay eqllqtenls
 241 aqvkatilqq lgwmhhtvdl lgdkatkesy aiqylqksle adpnsgqswy flgrcyssig
 301 kvqdafisyr qsidkseasa dtwcsigvly qqqnqpmdal qayicavqld hghaaawmdl
 361 gtlyescnqp qdaikcylna trskncsnts glaarikylq aqlcnlpqgs lqnktkllps
 421 ieeawslpip aeltsrqgam ntaqqntsdn wsggnapppv eqqthswclt pqklqhleql
 481 ranrnnlnpa qklmleqles qfvlmqqhqm rqtgvaqvrp tgilngptvd sslptnsvsg
 541 qqpqlpltrm psvsqpgvht acprqtlang pfsaghvpcs tsrtlgstdt vlignnhvtg
 601 sgsngnvpyl qrnaptlphn rtnltsstee pwknqlsnst qglhkgpssh lagpngerpl
 661 sstgpsqhlq aagsgiqnqn ghptlpsnsv tqgaalnhls shtatsgggq gitltkeskp
 721 sgntlcvpet srqtgetpns tasveglpnh vhqvmadavc spshgdsksp gllssdnpql
 781 sallmgkann nvgpgtcdkv nnihptvhtk tdnsvassps saistatpsp ksteqtttns
 841 vtslnsphsg lhtingegme esqspiktdl llvshrpspq iipsmsvsiy pssaevlkac
 901 rnlgknglsn ssilldkcpp prppsspypp lpkdklnppt psiylenkrd affpplhqfc
 961 tnpnnpvtvi rglagalkld lglfstktlv eannehmvev rtqllqpade nwdptgtkki
1021 whcesnrsht tiakyaqyqa ssfqeslree nekrshhkdh sdsestssdn sgkrrkgpfk
1081 tikfgtnidl sddkkwklql heltklpafv rvvsagnlls hvghtilgmn tvqlymkvpg
1141 srtpghqenn nfcsvninig pgdcewfvvp egywgvlndf ceknnlnflm gswwpnledl
1201 yeanvpvyrf iqrpgdlvwi nagtvhwvqa igwcnniawn vgpltacqyk laveryewnk
1261 lqnvksivpm vhlswnmarn ikvsdpklte mikycllrtl kqcqtlreal iaagkeiiwh
1321 grtkeepahy csicevevfd llfvtnesns rktyivhcqd carktsgnle nfvvleqykm
1381 edlmqvydqf tlvseinmll hyhpphldiv pwtlnmrptl lfrk
```

SEQ ID NO: 29 Human ARID1A cDNA Sequence Variant 1 (NM_006015.4. CDS: From 374 to 7231)

```
   1 cagaaagcgg agagtcacag cggggccagg ccctggggag cggagcctcc accgcccccc
  61 tcattcccag gcaagggctt gggggggaatg agccgggaga gccgggtccc gagcctacag
 121 agccgggagc agctgagccg ccggcgcctc ggccgccgcc gccgcctcct cctcctccgc
 181 cgccgccagc ccggagcctg agccgcgcgg gcggggggga gaggagcgag gcagccgcag
 241 cagcggagcc ccgcgaggcc cgcccgggcg ggtggggagg gcagcccggg ggactgggcc
 301 ccggggcggg gtgggagggg gggagaagac gaagacaggg ccgggtctct ccgcggacga
 361 gacagcgggg atcatggccg cgcaggtcgc ccccgccgcc gccagcagcc tgggcaaccc
 421 gccgccgccg ccgccctcgg agctgaagaa agccgagcag cagcagcggg aggaggcggg
 481 gggcgaggcg gcggcggcga cagcggccga gcgcggggaa atgaaggcag ccgccgggca
 541 ggaaagcgag ggccccgccg tggggccgcc gcagccgctg ggaaaggagc tgcaggacgg
 601 ggccgagagc aatgggggtg gcggcggcgg cggagccggc agcggcggcg ggcccggcgc
 661 ggagccggac ctgaagaact cgaacgggaa cgcgggccct aggcccgccc tgaacaataa
 721 cctcacggag ccgccggcg cggcggtgg cggcagcagc gatgggggtgg gggcgcctcc
 781 tcactcagcc gcggccgcct tgccgccccc agcctacggc ttcgggcaac cctacggccg
 841 gagcccgtct gcgtcgccg ccgccgcggc cgccgtcttc caccaacaac atggcggaca
 901 acaaagccct ggcctggcag cgctgcagag cggcggcggc ggggccctgg agcctacgc
 961 ggggcccca cagaactctc acgaccacgg cttccccaac caccagtaca actcctacta
1021 ccccaaccgc agcgcctacc ccccgccgc cccggcctac gcgctgagct cccgagaggt
1081 tggcactccg ggctccggcg cggcggcggc tgccggctcc aagccgcctc cctcctccag
1141 cgcctccgcc tcctcgtcgt cttcgtcctt cgctcagcag cgcttcgggg ccatgggggg
1201 aggcggcccc tccgcggccg gggggggaac tccccagccc accgccaccc ccacccctcaa
1261 ccaactgctc acgtcgccca gctcggcccg gggctaccag ggctacccg ggggcgacta
1321 cagtggcggg ccccaggacg gggcgccgg caagggcccg gcggacatgg cctcgcagtg
1381 ttggggggct gcggcggcgg cagctgcggc ggcggccgcc tcggagggg cccaacaaag
1441 gagccaccac gcgcccatga gcccccggag ggggggcagc cgctcgccgg cgctcgcccg
1501 gacccctcag ccatccagtc caatggatca gatgggcaag atgagacctc agccatatgg
1561 cgggactaac ccatactcgc agcaacaggg acctccgcca ggaccgcagc aaggacatgg
1621 gtacccaggg cagccatacg ggtcccagac cccgcagcgg taccccgatga ccatgcaggg
1681 ccgggcgcag agtgccatgg gcggcctctc ttatacacag cagattcctc cttatggaca
1741 acaaggcccc agcgggtatg gtcaacaggg ccagactcca tattacaacc agcaaagtcc
1801 tcaccctcag cagcagcagc cacccctactc ccagcaacca ccgtcccaga ccctcatgc
1861 ccaaccttcg tatcagcagc agccacagtc tcaaccacca cagctccagt cctctcagcc
1921 tccatactcc cagcagccat cccagcctcc acatcaggag tcccgatcc catacccctc
1981 ccagcagtcg acgacacagc agcacccca gagccagggc ccctactcac agccacaggc
2041 tcagtctcct taccagcagc agcaacctca gcagccagca ccctgacgc tctcccagca
2101 ggctgcgtat cctcagcccc agtctcagca gtcccagcaa actgccatt cccagcagcg
2161 cttccctcca ccgcaggagc tatctcaaga ttcatttggg tctcaggcat cctcagcccc
2221 ctcaatgacc tccagtaagg gagggcaaga agatatgaac ccgagccttc agtcaagacc
```

TABLE 1-continued

```
2281 ctccagcttg cctgatctat ctggttcaat agatgacctc cccatgggga cagaaggagc
2341 tctgagtcct ggagtgagca catcagggat ttccagcagc caaggagagc agagtaatcc
2401 agctcagtct cctttctctc ctcataccct ccctcacctg cctggcatcc gaggcccttc
2461 cccgtcccct gttggctctc ccgccagtgt tgctcagtct cgctcaggac cactctcgcc
2521 tgctgcagtg ccaggcaacc agatgccacc tcggccaccc agtggccagt cggacagcat
2581 catgcatcct tccatgaacc aatcaagcat tgcccaagat cgaggttata tgcagaggaa
2641 cccccagatg ccccagtaca gttcccccca gcccggctca gccttatctc cgcgtcagcc
2701 ttccggagga cagatacaca caggcatggg ctcctaccag cagaactcca tggggagcta
2761 tggtccccag ggggtcagt atggcccaca aggtggctac cccaggcagc caaactataa
2821 tgccttgccc aatgccaact accccagtgc aggcatggcc ggaggcataa accccatggg
2881 tgccggaggt caaatgcatg gacagcctgg catcccacct tatggcacac tccctccagg
2941 gaggatgagt cacgcctcca tgggcaaccg gccttatggc cccaacatgg ccaatatgcc
3001 acctcaggtt gggtcaggga tgtgtccccc accagggggc atgaaccgga aaacccaaga
3061 aactgccgtc gccatgcatg ttgctgccaa ctctatccaa aacaggccgc caggctaccc
3121 caatatgaat caaggggggca tgatgggaac tggacctcct tatggacaag ggattaatag
3181 tatggctggc acgatcaacc ctcagggacc cccatattcc atgggtggaa ccatggccaa
3241 caattctgca gggatggcag ccagcccaga gatgatgggc cttggggatg taaagttaac
3301 tccagccacc aaaatgaaca acaaggcaga tgggacaccc aagacagaat ccaaatccaa
3361 gaaatccagt tcttctacta caaccaatga aagatcacc aagttgtatg agctgggtgg
3421 tgagcctgag aggaagatgt gggtggaccg ttatctggcc ttcactgagg agaaggccat
3481 gggcatgaca aatctgcctg ctgtgggtag gaaacctctg gacctctatc gcctctatgt
3541 gtctgtgaag gagattggtg gattgactca ggtcaacaag aacaaaaaat ggcgggaact
3601 tgcaaccaac ctcaatgtgg gcacatcaag cagtgctgcc agctccttga aaaagcagta
3661 tatccagtgt ctctatgcct ttgaatgcaa gattgaacgg ggagaagacc ctcccccaga
3721 catctttgca gctgctgatt ccaagaagtc cagcccacag atccgcctcc cctctcctgc
3781 gggatcagga tctatgcagg ggccccagac tccccagtca accagcagtt ccatggcaga
3841 aggaggagac ttaaagccac caactccagc atccacacca cacagtcaga tcccccccatt
3901 gccaggcatg agcaggagca attcagttgg gatccaggat gcctttaatg atggaagtga
3961 ctccacattc cagaagcgga attccatgac tccaaacct gggtatcagc ccagtatgaa
4021 tacctctgac atgatggggc gcatgtccta tgagccaaat aaggatcctt atggcagcat
4081 gaggaaagct ccagggagtg atcccttcat gtcctcaggg cagggcccca acggcgggat
4141 gggtgacccc tacagtcgcg ctgccggccc tgggctagga aatgtggcga tgggaccacg
4201 acagcactat ccctatggag gtccttatga cagagtgagg acggagcctg gaatagggcc
4261 tgagggaaac atgagcactg gggcccaca gccgaatctc atgccttcca aaccagactc
4321 gggggatgtat tctcctagcc gctacccccc gcagcagcag cagcagcagc agcaacgaca
4381 tgattcctat ggcaatcagt tctccaccca aggcaccct tctggcagcc ccttccccag
4441 ccagcagact acaatgtatc aacagcaaca gcagaattac aagcggccaa tggatggcac
4501 atatggccct cctgccaagc ggcacgaagg ggagatgtac agcgtgccat acagcactgg
4561 gcaggggcag cctcagcagc agcagttgcc cccagcccag ccccagcctg ccagccagca
4621 acaagctgcc cagccttccc ctcagcaaga tgtatacaac cagtatggca atgcctatcc
4681 tgccactgcc acagctgcta ctgagcgccg accagcaggc ggccccccaga accaatttcc
4741 attccagttt ggccgagacc gtgtctctgc accccctgcc accaatgccc agcaaaacat
4801 gccaccacaa atgatgggc gccccataca ggcatcagct gaggttgctc agcaaggcac
4861 catgtggcag gggcgtaatg acatgaccta taattatgcc aacaggcaga gcacgggctc
4921 tgcccccag ggccccgcct atcatggcgt gaaccgaaca gacgaaatgc tgcacacaga
4981 tcagagggcc aaccacgaag gctcgtggcc ttcccatggc acacgccatg catgctatgg
5041 tccctctgcc cctgtgcccc ccatgacaag gccccctcca tctaactacc agcccccacc
5101 aagcatgcag aatcacattc ctcaggtatc cagccctgct ccctgcccc ggccaatgga
5161 gaaccgcacc tctcctagca agtctccatt cctgcactct gggatgaaaa tgcagaaggc
5221 aggtccccca gtacctgcct cgcacatagc acctgcccct gtgcagcccc ccatgattcg
5281 gcgggatatc accttccac ctggctctgt gaagccaca cagcctgtgt tgaagcagag
5341 gaggcggctc acaatgaaag acattggaac cccggaggca tggcgggtaa tgacgtccct
5401 caagtctggt ctcctggcag agagcacatg ggcattagat accatcaaca tcctgctgta
5461 tgatgacaac agcatcatga ccttcaacct cagtcagctc ccagggttgc tagagctcct
5521 tgtagaatat ttccgacgat gcctgattga gatcttttggc attttaaagg agtatgaggt
5581 gggtgaccca ggacagagaa cgctactgga tcctgggagg ttcagcaagg tgtctagtcc
5641 agctccacg gagggtgggg aagaagaaga agaacttcta ggtcctaaac tagaaggaga
5701 agaagaagag gaagtagttg aaaatgatga ggagatagcc ttttcaggca aggacaagcc
5761 agcttcagag aatagtgagg agaagctgat cagtaagttt gacaagcttc cagtaaagat
5821 cgtacagaag aatgatccat ttgtggtgga ctgctcagat aagcttgggc gtgtgcagga
5881 gtttgacagt ggcctgctgc actggcggat tggtgggggg gacaccactg agcatatcca
5941 gacccacttc gagagcaaga cagagctgct gccttcccgg cctcacgcac cctgcccacc
6001 agcccctcgg aagcatgtga caacagcaga ggtacacca gggacaacag accaggaggg
6061 gccccacct gatggacctc cagaaaaacg gatcacagcc actatggatg acatgttgtc
6121 tactcggtct agcaccttga ccgaggatgg agctaagagt tcagaggcca tcaaggagag
6181 cagcaagttt ccatttggca ttagcccagc acagagccac cggaacatca gatcctaga
6241 ggacgaaccc cacagtaagg atgagacccc actgtgtgacc cttctggact ggcaggattc
6301 tcttgccaag cgctgcgtct gtgtgtccaa taccattcga agcctgtcat ttgtgccagg
6361 caatgacttt gagatgtcca acaccccagg gctgctgctc atcctgggca agctgatcct
6421 gctgcaccac aagcacccag aacggaagca ggcaccacta acttatgaaa aggaggagga
6481 acaggaccaa gggtgagct gcaacaaagt ggagtggttgct tgggactgct tggagatgct
6541 ccgggaaaac accttggtta cactcgccaa catctcgggg cagttggacc tatctccata
6601 ccccgagagc atttgcctgc ctgtcctgga cggactccta cactgggcag tttgcccttc
6661 agctgaagcc caggaccct tttccaccct gggcccaat gccgtccttt cccgcagag
6721 actggtcttg gaaaccctca gcaaactcag catccaggac aacaatgtgg acttcctgct
6781 ggcacaccc cccttcagcc gcctggagaa gttgtatagc actatggtgg gcttcctcag
6841 tgaccgaaag aacccggtgt gccgggagat ggctgtggta ctgctggcca acctggctca
6901 ggggacagc ctggcagctc gtgccattgc agtgcagaag ggcagtatcg gcaacctcct
6961 gggcttccta gaggacagcc ttgccgccac acagttccag cagagccagg ccagcctcct
7021 ccacatgcag aacccaccct ttgagccaac tagtgtggac atgatgcggc gggctgcccg
```

TABLE 1-continued

```
7081  cgcgctgctt gccttggcca aggtggacga gaaccactca gagtttactc tgtacgaatc
7141  acggctgttg gacatctcgg tatcaccgtt gatgaactca ttggcttcac aagtcatttg
7201  tgatgtactg tttttgattg gccagtcatg acagccgtgg gacacctccc cccccgtgt
7261  gtgtgtgcgt gtgtggagaa cttagaaact gactgttgcc ctttatttat gcaaaaccac
7321  ctcagaatcc agtttaccct gtgctgtcca gcttctccct tgggaaaaag tctctcctgt
7381  ttctctctcc tccttccacc tcccctccct ccatcacctc acgccttttct gttccttgtc
7441  ctcaccttac tcccctcagg accctacccc accctctttg aaaagacaaa gctctgccta
7501  catagaagac tttttttatt ttaaccaaag ttactgttgt ttacagtgag tttggggaaa
7561  aaaaataaaa taaaaatggc tttcccagtc cttgcatcaa cgggatgcca catttcataa
7621  ctgttttta tggtaaaaaa aaaaaaaaaa aatacaaaaa aaaattctga aggacaaaaa
7681  aggtgactgc tgaactgtgt gtggtttatt gttgtacatt cacaaccttg caggagccaa
7741  gaagttcgca gttgtgaaca gaccctgttc actggagagg cctgtgcagt agagtgtaga
7801  cccttcatg tactgtactg tacacctgat actgtaaaca tactgtaata ataatgtctc
7861  acatggaaac agaaaacgct gggtcagcag caagctgtag ttttttaaaaa tgtttttagt
7921  taaacgttga ggagaaaaaa aaaaaaggct ttccccccaa agtatcatgt gtgaacctac
7981  aacaccctga cctctttctc tcctccttga ttgtatgaat aaccctgaga tcacctctta
8041  gaactggttt taaccttag ctgcagcggc cgtgcgtaca cgtgtgtata tatatgacgt
8101  tgtacattgc acatacccctt ggatccccac agtttggtcc tcctcccagc tacccctttta
8161  tagtatgacg agttaacaag ttggtgacct gcacaaagcg agacacagct attttaatctc
8221  ttgccagata tcgcccctct tggtgcgatg ctgtacaggt ctctgtaaaa agtccttgct
8281  gtctcagcag ccaatcaact tatagtttat ttttttctgg gttttttgtt tgttttttgtt
8341  tctttctaat cgaggtgtga aaaagttcta ggttcagttg aagttctgat gaagaaacac
8401  aattgagatt ttttcagtga taaaatctgc atatttgtat ttcaacaatg tagctaaaac
8461  ttgatgtaaa ttcctccttt ttttccttt ttggcttaat gaatatcatt tattcagtat
8521  gaaatcttta tactatatgt tccacgtgtt aagaataaat gtacattaaa tcttggtaag
8581  acttt
```

SEQ ID NO: 30 Human ARID1A Amino Acid Sequence isoform A (NP_006006.3)

```
   1  maaqvapaaa sslgnppppp pselkkaeqq qreeaggeaa aaaaaergem kaaaggeseg
  61  pavgppqplg kelqdgaesn gggggggags gggpgaepdl knsngnagpr palnnnltep
 121  pggggggssd gvgapphsaa aalpppaygf gqpygrspsa vaaaaaavfh qqhgggqspg
 181  laalqsgggg glepyagpqq nshdhgtpnh qynsyypnrs aypppapaya lssprggtpg
 241  sgaaaaagsk pppsssasas ssssfaqqr fgamggggps aagggtpqpt atptlnqllt
 301  spssargyqg ypggdysggp qdggagkgpa dmasqcwgaa aaaaaaaaas ggaqqrshha
 361  pmspgssggg gqplartqgp sspmdqmgkm rpqpyggtnp ysqqqgppsg pqqghgypgq
 421  pygsqtpqry pmtmqgraqs amgglsytqq ippygqqgps gygqgqtpy ynqqsphpqq
 481  qqppysqqpp sqtphaqpsy qqqpqsqppq lqssqppysq qpsqpphqqs papypsqqst
 541  tqqhpqsqpp ysqpqaqspy qqqpqqpap stlsqqaqsp qqpsqqsqqt aysqqrfppp
 601  qelsqdsfgs qassapsmts skggqedmnl slqsrpsslp dlsgsiddlp mgtegalspg
 661  vststsgisssq geqsnpaqsp fsphtsphlp girgpspspv gspasvaqsr sgplspaavp
 721  gnqmpprpps gqsdsimhps mnqssiaqdr gymqrnpqmp qysspqpgsa lsprqpsggq
 781  ihrgmgsyqq nsmgsygpqg gqygpqggyp rqpnynalpn anypsagmag ginpmgaggq
 841  mhgqpgippy gtlppgrmsh asmgnrpygp nmanmppqvg sgmcpppggm nrktqetava
 901  mhvaansiqn rppgypnmnq ggmmgtgppy gqginsmagm inpqgppysm ggtmannsag
 961  maaspemmgl gdvkltpatk mnnkadgtpk teskskksss stttnekitk lyelggeper
1021  kmwvdrylat teekamgmtn lpavgrkpld lyrlyvsvke iggltqvnkn kkwrelatnl
1081  nvgtsssaas slkkqyiqcl yafeckierg edpppdifaa adskksqpki qppspagsgs
1141  mqgpqtpqst sssmaeggdl kpptpastph sqipplpgms rsnsvgiqda fndgsdstfq
1201  krnsmtpnpg yqpsmntsdm mgrmsyepnk dpygsmrkap gsdpfmssgq gpnggmgdpy
1261  sraapgglgn vamgprqhyp yggpydrvrt epgigpegnm stgapqpnlm psnpdsgmys
1321  psryppqqqq qqqqrhdsyg nqfstqgtps gspfpsqqtt myqqqqqnyk rpmdgtygpp
1381  akrhegemys vpystgqgqp qqqqippaqp qpasqqqaaq pspqqdvynq ygnaypatat
1441  aaterrpagg pqnqtptqtg rdrvsappgt naqqnmppqm mggpiqasae vaqqgtmwqg
1501  rndmtynyan rqstgsapqg payhgvnrtd emlhtdqran hegswpshgc rqppygpsap
1561  vppmtrppps nyqpppsmqn hipqvsspap lprpmenrts pskspflhsg mkmqkagppv
1621  pashiapapv qppmirrdit fppgsveatq pvlkqrrrlt mkdigtpeaw rvmmslksgl
1681  laestwaldt inillyddns imtfnlsqlp gllellveyf rrclieftgi lkeyevgdpg
1741  qrtlldpgrf skvsspapme ggeeeellg pkleeeeeee vvendeeiaf sgkdkpasen
1801  seekliskfd klpvkivqkn dpfvvdcsdk lgrvqefdsg llhwrigggd ttehiqthfe
1861  sktellpsrp hapcppapck hvttaegtpg ttdqegpppd gppekritat mddmlstrss
1921  tltedgakss eaikesskfp fgispaqshr nikileedph skdetplctl ldwqdslakr
1981  cvcvsntirs lsfvpgndfe mskhpgllli lgklillhhk hperkqaplt yekeeeqdqg
2041  vscnkvewww dclemlrent lvtlanisgq ldlspypesi clpvldgllh wavcpsaeaq
2101  dpfstlgpna vlspqrlvle tlsklsiqdn nvdlilatpp fsrleklyst mvrflsdrkn
2161  pvcremavvl lanlaqgdsl aaraiavqkg signllgfle dslaatqfqq sqasllhmqn
2221  ppfeptsvdm mrraaralla lakvdenhse ftlyesrlld isvsplmnsl vsqvicdvlf
2281  ligqs
```

SEQ ID NO: 31 Human ARID1A cDNA Sequence Variant 2 (NM_139135.2. CDS: from 374 to 6580)

```
   1  cagaaagcgg agagtcacag cggggccagg ccctggggag cggagcctcc accgcccccc
  61  tcattcccag gcaagggctt ggggggaatg agccgggaga gccgggtccc gagcctacag
 121  agccgggagc agctgagccg ccggcgcctc ggccgccgcc gccgcctcct cctcctccgc
 181  cgccgccagc ccggagcctg agccgcgggg gcggggggga gaggagcgag cgcagcgcag
 241  cagccggagc ccgcgaggcc cgcccggcgg ggtggggagg gcagcccggg ggactgggcc
 301  ccggggcggg gtggggagggg gggagaagac gaagacaggg ccgggtctct ccgcggacga
 361  gacagcgggg atcatggccg cgcaggtcgc cccgccgcc gccagcagcc tgggcaaccc
 481  gggcgagcg gcggcgcgg cagcggccga gcgcgggaa atgaaggcag ccgccgggca
 541  ggaaagcgag ggccccgccg tgggccgcc gcagccgctg gaaaggagc tgcaggacgg
 601  ggccgagagc aatgggggtg gcggcggcgg cggagccggc agcggcggcg ggcccggcgc
```

TABLE 1-continued

```
 661 ggagccggac ctgaagaact cgaacgggaa cgcgggccct aggcccgccc tgaacaataa
 721 cctcacggag ccgcccggcg gcggcggtgg cggcagcagc gatggggtgg gggcgcctcc
 781 tcactcagcc gcggccgcct tgccgccccc agcctacggc ttcgggcaac cctacggccg
 841 gagcccgtct gccgtcgccg ccgccgcggc cgccgtcttc caccaacaac atggcggaca
 901 acaaagccct ggcctggcag cgctgcagag cggcggccgg ccggcggcgg cggggcctgg agccctacgc
 961 ggggcccag cagaactctc acgaccacgg cttcccaac caccagtaca actcctacta
1021 ccccaaccgc agcgcctacc ccccgcccgc cccggcctac gcgctgagct ccccgagagg
1081 tggcactccg ggctccggcc cggcggcggc tgccggctcc aagccgcctc cctcctccag
1141 cgcctccgcc tcctcgtcgt cttcgtcctt cgctcagcag cgcttcgggg ccatggggggg
1201 aggcggcccc tccgcggccg gcgggagaac tccccagccc accgccaccc ccaccctcaa
1261 ccaactgctc acgtcgccca gctcggcccg gggctaccag ggctacccccg ggggcgacta
1321 cagtggcggg ccccaggacg ggggcgccgg caagggcccg gcggacatgg cctcgcagtg
1381 ttgggggggct gcggcggcgg cagctgcggc ggcggccgcc tcgggagggg cccaacaaag
1441 gagccaccac gcgcccatga gccccgggag cagccggcgg ggggggcagc cgctcgcccg
1501 gaccccctcag ccatccagtc caatggatca gatgggcaag atgagacctc agccatatgg
1561 cgggactaac ccatactcgc agcaacaggg acctccgtca ggaccgcagc aaggacatgg
1621 gtacccaggg cagccatacg ggtcccagac cccgcagcgg tacccgacga ccatgcaggg
1681 ccgggcgcag agtgccatgg gcggcctctc ttatacacag cagattcctc cttatggaca
1741 acaaggcccc agcgggtatg tcaacaggg ccagactcca tattacaacc agcaaagtcc
1801 tcaccctcag cagcagcagc caccctactc ccagcaacca ccgtcccaga cccctcatgc
1861 ccaaccttcg tatcagcagc agccacagtc tcaaccacca cagctccagt cctctcagcc
1921 tccatactcc cagcagccat cccagcctcc acatcagcag tccccggctc catacccctc
1981 ccagcagtcg acgacacagc agcaccccca gagccagccc cctactcac agccacaggc
2041 tcagtctcct taccagcagc agcaacctca gcagccagca ccctcgacgc tctcccagca
2101 ggctgcgtat cctcagcccc agtcccagca gtcccagcaa actgcctatt cccagcaggg
2161 cttccctcca ccgcaggagc tatctcaaga ttcatttggg tctcaggcat cctcagcccc
2221 ctcaatgacc tccagtaagg gagggcaaga agatatgaac ctgagccttc agtcaagacc
2281 ctccagcttg cctgatctat ctggttcaat agatgacctc cccatgggga cagaaggagc
2341 tctgagtcct ggagtgagca catcagggat ttccagcagc caaggagagc agagtaatcc
2401 agctcagtct cctttctctc ctcacacctc ccctcacctg cctggcatcc gaggcccttc
2461 cccgtcccct gttggctctc ccgccagtgt tgctcagtct cgctcaggac cactctcgcc
2521 tgctgcagtg ccaggcaacc agatgccacc tcggccaccc agtggccagt cggacagcat
2581 catgcatcct tccatgaacc aatcaagcat tgcccaagat cgaggttata tgcagaggaa
2641 ccccagatg cccagtaca gttcccccca gccggctca gccttatctc cgcgtcagcc
2701 ttccggagga cagatacaca caggcatggg ctcctaccag cagaactcca tggggagcta
2761 tggtcccag ggggtcagt atgcccaca aggtggccac cccaggcagc caaactataa
2821 tgccttgccc aatgccaact accccagtgc aggcatggct ggaggcataa accccatggg
2881 tgccggaggt caaacgcatg gacagcctgg catcccacct tatggcacac tccctccagg
2941 gaggatgagt cacgcctcca tggcaaccg gccttatgcc cctaacatgg ccaatatgcc
3001 acctcaggtt gggtcaggga tgtgtccccc accagggggc atgaaccgga aaacccaaga
3061 aactgctgcc gccatgcatg ttgctgccaa ctctatccaa aacaggccgc caggctaccc
3121 caatatgaat caaggggggca tgatgggaac tggacctcct tatggacagg ggattaatag
3181 tatgctggc acgatcaacc ctcagggacc cccacattcc atggggtggaa ccatggccaa
3241 caattctgca gggatggcag ccagcccaga gatgatgggc cttggggatg taaagttaac
3301 tccagccacc aaaatgaaca acaaggcaga tgggacaccc aagacagaat ccaaatccaa
3361 gaaatccagt tcttctacta caaccaatga gaagatccac aagttgtata agctgggtgg
3421 tgagcctgag aggaagatgt gggtgaccg ttatctggcc ttcactgagg agaaggccat
3481 gggcatgaca aatctgcctc ctgtgggtag gaaacctctg gacctctatc gcctctatgt
3541 gtctgtgaag gagattggcg gattgactca ggtcaacaag aacaaaaaat ggcgggaact
3601 tgcaaccaac ctcaatgtgg gcacatcaag cagtgctgcc agctccttga aaaagcagta
3661 tatccagtgt ctctatgcct ttgaatgcaa gattgaacgg ggagaagacc ctcccccaga
3721 catctttgca gctgctgatt ccaagaagtc ccagcccaag atccagcctc cctctcctgc
3781 gggatcagga tctatgcagg ggcccagac tccccagcca accagcagtt ccatggcaga
3841 aggaggagac ttaaagccac caactccagc atccacaca cacagtcaga tcccccccatt
3901 gccaggcatg agcaggagca attcagttgg gatccaggat gcccttaatg atggaagtga
3961 ctccacattc cagaagcgga attccatgac tccaaaccct gggtatcagc ccagtatgaa
4021 tacctctgac atgatgggggc gcatgtccca tgagccaaat aaggatcctt atggcagcat
4081 gaggaaagct ccagggagtg atcccttcat gtcctcaggg cagggcccca acggcgggat
4141 gggtgacccc tacagtcgtg ctgccggccc tgggctagga aatgtggcga tgggaccacg
4201 acagcactat ccctatggag gtcccttatga cagagtgagg acggagcctg gaatagggcc
4261 tgagggaaac atgagcactg gggcccaca gccgaatctc atgccttcca acccagactc
4321 ggggatgtat tctcctagcc gctaccccccc gcagcagcag cagcagcagc agcaacgaca
4381 tgattcctat ggcaatcagt tctccacccca aggcaccect tctggcagcc ccttccccag
4441 ccagcagact acaatgtatc aacagcaaca gcaggtatcc agccctgctc ccctgccccg
4501 gccaatggag aaccgcacct ctcctagcaa gtctccattc ctgcactctg ggatgaaaat
4561 gcagaaggca ggtccccag tacctgcctc gcacatagca cctgccctg tgcagccccc
4621 catgattcgg gggatatca ccttcccacc tggctctgtt gaagccacac agctgtgtt
4681 gaagcagagg aggcggctca caatgaaaga cattgaacc ccggaggcat ggcgggtaat
4741 gatgtccctc aagtctggtc tcctggcaga gagcacatgg gcattagata ccatcaacat
4801 cctgctgtat gatgacaaca gcatcatgac cttcaacctc agtcagctcc cagggttgct
4861 agagctcctt gtagaatatt tccgacgatg gctgattgag atcttggca ttttaaagga
4921 gtatgaggtg ggtgacccag gacagagaac gctactggat cctggggaggt tcagcaaggt
4981 gtctagtcca gctcccatgg agggtgggga agaagaagaa gaacttctag gtcctaaact
5041 agaagaggaa gaagaagagg aagtagttga aaatgatgag gagatagcct tttcaggcaa
5101 ggacaagcca gcttcagaga atagtgagga acaagcttcc
5161 agtaaagatc gtacagaaga atgatccatt tgtggtggac tgctcagata agcttgggcg
5221 tgtgcaggag tttgacagtg gcctgctgca ctggcggatt ggtggggggg acaccactga
5281 gcatatccag acccacttcg agagcaagac agagctgctg ccctcccggc ctcacgcacc
5341 ctgcccacca gcccctcgga agcatgtgac aacagcagag ggtacaccag ggacaacaga
5401 ccaggagggg cccccacctg atggacctcc agaaaaacg atcacagcca ctatggatga
```

TABLE 1-continued

```
5461 catgttgtct actcggtcta gcaccttgac cgaggatgga gctaagagtt cagaggccat
5521 caaggagagc agcaagtttc catttggcat tagcccagca cagagccacc ggaacatcaa
5581 gatcctagag gacgaacccc acagtaagga tgagacccca ctgtgtaccc ttctggactg
5641 gcaggattct cttgccaagc gctgcgtctg tgtgtccaat accattcgaa gcctgccatt
5701 tgtgccaggc aatgactttg agatgtccaa acacccaggg ctgctgctca tcctgggcaa
5761 gctgatcctg ctgcaccaca agcacccaga acggaagcag gcaccactaa cttatgaaaa
5821 ggaggaggaa caggaccaag gggtgagctg caacaaagtg gagtggtggt gggactgctt
5881 ggagatgctc cgggaaaaca ccttggttac actcgccaac atctcggggc agttggacct
5941 atctccatac cccgagagca tttgcctgcc tgtcctggac ggactcctac actgggcagt
6001 ttgcccttca gctgaagccc aggacccctt ttccaccctg ggccccaatg ccgtcctttc
6061 cccgcagaga ccggtcttgg aaaccctcag caaactcagc atccaggaca caatgtggaa
6121 cccgattctg gccacacccc ccttcagccg cctggagaag ttgtatagca ctatggtgcg
6181 cttcctcagt gaccgaaaga acccggtgtg ccgggacgtg gctgtggtac tgctggccaa
6241 cctggctcag ggggacagcc tggcagctcg tgccattgca gcgcagaagg gcagtatcgg
6301 caacctcctg ggcttcctag aggacagcct tgccgccaca cagttccagc agagccaggc
6361 cagcctcctc cacatgcaga acccaccctt tgagccaact agtgtggaca tgatgcggcg
6421 ggctgcccgc gcgctgcttg ccttggccaa ggtggacgag aaccactcag agtttactct
6481 gtacgaatca cggctgttgg acatctcggt atcaccgttg atgaactcat tggtttcaca
6541 agtcatttgt gatgtactgt ttttgattgg ccagtcatga cagccgtggg acacctcccc
6601 cccccgtgtg tgtgcgcgtg tgcggagaac ttagaaactg actgttgccc tttatttatg
6661 caaaaccacc tcagaatcca gtttaccctg tgctgtccag cttctccctt gggaaaaagt
6721 ctctcctgtt tctctctcct ccttccacct ccctcccctc catcacctca cgcctttccg
6781 ttccttgtcc tcaccttact cccctcagga ccctacccca cctcttttga aaagacaaag
6841 ctctgcctac atagaagact ttttttattt taaccaaagt tactgttgtt tacagtgagt
6901 ttggggaaaa aaaacaaaat aaaaatggct ttcccagtcc ttgcatcaac gggatgccac
6961 atttcataac tgtttttaat ggtaaaaaaa aaaaaaaaaa atacaaaaaa aaattctgaa
7021 ggacaaaaaa ggtgactgct gaactgtgtg tggtttattg ttgcacattc acaatcttgc
7081 aggagccaag aagttcgcag ttgtgaacag accctgttca ctggagaggc ctgtgcagta
7141 gagtgtagac cctttcatgt actgtactgt acacctgata ccgtaaacat actgtaataa
7201 taatgtctca catggaaaca gaaaacgctg ggtcagcagc aagctgtagt ttttaaaaat
7261 gtttttagtt aaacgttgag gagaaaaaaa aaaaaggctt tccccccaaa gtatcatgtg
7321 tgaacctaca acaccctgac ctctttctct cctccttgat tgtatgaata accctgagat
7381 cacctcttag aactggtttt aacctttagc tgcagcggct acgctgccac gtgtgtatat
7441 atatgacgtt gtacattgca catacccttg gatccccaca gtttggtcct cctcccagct
7501 acccctttat agtatgacga gttaacaagt tggtgacctg cacaaagcga gacacagcta
7561 tttaatctct tgccagatat cgcccctctt ggtgcgatgc tgtacaggtc tctgtaaaaa
7621 gtccttgctg tctcagcagc caatcaactt atagtttatt tttttctggg tttttgtttt
7681 gttttgtttt ctttctaatc gaggtgtgaa aaagttctag gttcagttga agttctgacg
7741 aagaaacaca actgagattt tttcagtgat aaaatctgca tatttgtatt tcaacaatgt
7801 agctaaaact tgatgtaaat tcctcctttt tttccttttt tggcttaatg aatatcattt
7861 attcagtatg aaatctttat actatatgtt ccacgtgtta agaataaatg tacattaaat
7921 ctcggtaaga cttt
```

SEQ ID NO: 32 Human ARID1A Amino Acid Sequence isoform B (NP_624361.1)

```
   1 maaqvapaaa sslgnppppp pselkkaeqq qreeaggeaa aaaaaergem kaaagqeseg
  61 pavgppqplg kelqdgaesn ggggggags gggpgaepdl knsngnagpr palnnnltep
 121 pggggggssd gvgapphsaa aalpppaygf gqpygrspsa vaaaaaavfh qqhggqqspg
 181 laalqsgggg glepyagpqq nshdhgfpnh qynsyypnrs ayppрараya lssprggtpg
 241 sgaaaaagsk pppsssasas ssssfaqqr fgamggggps aagggtpqpt atptlnqllt
 301 spssargyqg ypggdysggp qdggagkgpa dmasqcwgaa aaaaaaaaas ggaqqrshha
 361 pmspgssggg gqplartpqp sspmdqmgkm rpqpyggtnp ysqqqgppsg pqqghgypgq
 421 pygsqtpqry pmtmqgraqs amgglsytqq ippygqqgps gygqqgqtpy ynqqsphpqq
 481 qqppysqqpp sqtphaqpsy qqqpqsqppq lqssqppysq qpsqpphqqs papypsqqst
 541 tqqhpqsqpp ysqpqaqspy qqqpqqpap stlsqqaayp qpqsqqsqqt aysqqrfppp
 601 qelsqdsfgs qassapsmts skgggqedmnl slqsrpsslp dlsgsiddlp mgtegalspg
 661 vststgisssq geqsnpaqsp fsphtsphlp girgpspspv gspasvaqsr sgplspaavp
 721 gnqmpprpps gqsdsimhps mnqssiaqdr gymqrnpqmp qysspqpgsa lsprqpsggq
 781 ihtgmgsyqq nsmgsygpqg gqygpqggyp rqpnynalpn anypsagmag ginpmgaggq
 841 mhgqpgippy gtlppgrmsh asmgnrpygp nmanmppqvg sgmcpppggm nrktqetava
 901 mhvaansiqn rppgypnmnq ggmmgtgppy gqginsmagm inpqgppysm ggtmannsag
 961 maaspemmgl gdvkltpatk mnnkadgtpk teskskksss stttnekitk lyelggeper
1021 kmwvdrylaf teekamgmtn lpavgrkpld lyrlyvsvke iggltqvnkn kkwrelatnl
1081 nvgtsssaas slkkqyiqcl yafeckierg edpppdifaa adskksqpki qppspagsgs
1141 mqgpqtpqst sssmaeggdl kpptpastph sqipplpgms rsnsvgiqda fndgsdsrfq
1201 krnsmtpnpg yqpsmntsdm mgrmsyepnk dpygsmrkap gsdfmssggq gpnggmgdpy
1261 sraagpglgn vamgprqhyp yggpydrvrt epgigpegnm stgapqpnlm psnpdsgmys
1321 psryppqqqq qqqqrhdsyg nqfstqgtps gspfpsqqtt myqqqqqvss paplprpmen
1381 rtspskspfl hsgmkmqkag ppvpashiap apvqppmirr ditfppgsve atqpvlkqrr
1441 rltmkdigtp eawrvmmslk sgllaestwa ldtinillyd dnsimtfnls qlpgllellv
1501 eyfrrcliei fgilkeyevg dpgqrtlldp grfskvsspa pmeggeeeee llgpkleeee
1561 eeevvendee iafsgkdkpa senseeklis kfdklpvkiv qkndpfvvdc sdklgrvqef
1621 dsgllhwrig ggdttehiqt hfesktellp srphapcppa prkhvttaeg tpgttdqegp
1681 ppdgppekri tatmddmlst rsstltedga ksseaikess kfpfgispaq shrnikiled
1741 ephskdetpl ctlldwqdsl akrcvcvsnt irslsfvpgn dfemskhpgl lllilgklill
1801 hhkhperkqa pltyekeeeq dqgvscnkve wwwdclemlr entlvtlani sgqldlspyp
1861 esiclpvldg llhwavcpsa eaqdpfstlg pnavlspqrl vletlsklsi qdnnvdlila
1921 tppfsrlekl yscmvrflsd rknpvcrema vvllanlaqg dslaaraiav qkgsignllg
1981 fledslaatq fqqsqasllh mqnppfepts vdmmrraara llalakvden hseftlyesr
2041 lldisvsplm nslvsqvicd vlfligqs
```

TABLE 1-continued

SEQ ID NO: 33 Mouse ARID1A cDNA Sequence (NM_001080819.1. CDS: from 1 to 6852)

```
   1 atggccgcgc aggtcgcccc cgccgccgcc agcagcctgg gcaacccgcc gccgccgccc
  61 tcggagctga agaaagccga gcagcaacag cgggaggagg cggggggcga ggcggcggcg
 121 gcagcggccg agcgcgggga aatgaaggca gccgccggcc aggagagcga gggccccgcc
 181 gtggggccgc cgcagccgct gggaaaggag ctgcaggacg gggccgagag caatgggggt
 241 ggcggcgcg gcggagccgg cagcggcggc gggcccggcc cggagccgga cctgaagaac
 301 tcgaacggga acgcgggccc taggcccgcc ctgaacaata acctcccgga gccgcccggc
 361 ggcggcgcg gcggcggcag cagcagcagc gacggggtgg gggcgcctcc tcactcggcc
 421 gcggccgccc tgccgccccc agcctacggc ttcgggcaag cctacggccg gagcccgtct
 481 gccgtcgccg ccgcggcggc cgccgtcttc caccaacaac atggcggaca caaagccct
 541 ggcctggcag cgctgcagag cggcggcggc gggggcttgg agccctacgc cggcgcccag
 601 cagaactcgc acgaccacgg cttccccaac caccagtaca actcctacca ccccaaccgc
 661 agcgcctacc ccccgcctcc ccaggcctac gcgctgagct ccccgagagg tggcactccg
 721 ggctccgcg cggcggcgg cgccggctcc aagccgcctc cctcctccag cgcctctgcc
 781 tcctcgtcgt cttcgtcctt cgcacagcag cgcttcgggg ccatggggg aggcggcccc
 841 tcagcggccg gcgggggaac tccccagccc accgccaccc ccacccccaa ccaactgctc
 901 acgtcgccca gctcggcccg tggctaccag ggctaccccg gggcgacta cggcggcggg
 961 ccccaggacg ggggcgcggg caaaggcccg gcggacatgg cctcgcagtg ctgggggct
1021 gcggcggcgg cggcggcggc ggcagcggcc gtctcggag gggcccaaca aaggagccac
1081 cacgcgccca tgagcccgg gagcagcggc ggcggggc agccgctcgc ccggaccct
1141 cagtcatcca gtccaatgga tcagatggga aagatgagac ctcagccgta tggtgggact
1201 aacccatact cgcaacaaca gggacctcct tcaggaccgc aacaaggaca tgggtaccca
1261 gggcagccat atgggtccca gactccacag cggtacccca tgaccatgca gggccgggct
1321 cagagtgcca tgggcagcct ctcttatgca cagcagatcc caccttatgg ccagcaaggc
1381 cccagtgcgt atggccagca gggccagact ccatactata accagcaaag tcctcatccc
1441 cagcagcagc caccctacgc ccagcaacca ccatcccaga ccccctcatgc ccagccttcg
1501 tatcagcagc agccgcagac tcagcaacca cagcttcagt cctctcagcc tccatattcc
1561 cagcagccat cccagcctcc acatcagcag tcccccaactc catatccctc ccagcagtcc
1621 accacacaac agcatcccca gagccagccc ccctactcac aaccacaggc acagtctccc
1681 taccagcagc agcaacctca gcagccagca tcctcgtcgc ctcccagca ggctgcatat
1741 cctcagcccc agcctcagca gtcccagcaa actgccatt cccagcagcg cttccctcca
1801 ccacaggagc tttctcaaga ttcatttggg tctcaggcat cctcagcccc ctcaatgacc
1861 tccagtaagg gagggcaaga agatatgaac ctgagtcttc agtcaaggcc ctccagcttg
1921 cctgatctgt ctggttcaat cgatgatctc cccatgggga cagaaggagc tctgagtcgt
1981 ggcgtgagca catcagggat ttcagcagc caaggagagc agagcaatcc agctcagtct
2041 ccctttttctc ctcacacctc ccctcacctg cctggcatcc gaggcccgtc cccgtccct
2101 gttggctctc ctgccagct cgcgcagtct cgctcaggac cactctcgcc tgctgcagtg
2161 ccaggcaacc agatgccacc tcggccaccc agtgccagt cagacagcat catgcaccct
2221 tccatgaacc aatcaagcat tgcccaagat cgaggttata tgcagaggaa cccccagatg
2281 ccccagtaca cttcccctca gcctggctcg gccttatccc cacgtcagcc gtctggagga
2341 cagatgcact cgggcgtggg ctcctaccag cagaactcca tggggagcta cggcccccag
2401 ggcagtcagt atggcccaca aggaggctat cctaggcagc ctaactataa tgccttgccc
2461 aacgccaact accccaatgc aggcatggcc ggaagtatga cccctatggg tgccggaggt
2521 cagatgcatg ggcagcctgg aatcccacct tacggcacac tccctccagg gagaatggct
2581 catgcgtcta tgggcaacag gcccatggc cctaatatgg ccaatatgcc acctcaggtt
2641 gggtcaggga tgtgtcctcc accaggggga atgaacagga aaactcaaga gtctgctgtt
2701 gccatgcatg ttgctgccaa ctctatccaa aacaggccac caggctaccc aaatatgaat
2761 caaggggca tgatgggaac tggacctccc tatggacagg ggatcaatag tatggctggc
2821 atgatcaacc ctcagggacc ccatatcct gtgggtggca ccatggccaa caattcagca
2881 gggatggcag ccagcccaga gatgatgggc cttggggatg ttaagttaac tcccgccaca
2941 aaaatgaaca caaggcaga tggaacaccc aagacagaat ccaaatctaa gaaatccagt
3001 tcttctacca ccaccaatga gaagatcacc aaattgtatg agttgggtgg tgagcccgag
3061 aggaagatgt gggtggaccg gtacctggcc ttcacagagg agaaggccat gggcatgaca
3121 aatctgcctg ctgtggggag gaagcctctg gacctctcag gcctctatgt gtctgtgaag
3181 gagattggtg ggttgactca ggtcaacaag aacaaaaaat ggcgggaact tgcaaccaac
3241 ctcaatgtgg gtacatcaag cagtgctgcc agctcactga aaaagcagta tatccaatgt
3301 ctctatgcct ttgagtgcaa gatcgagcgt ggagaagacc ctccccccga tatcttcgca
3361 gctgctgact ccaagaagtc ccaacccaag atccagcccc cctctcctgc cggatcaggg
3421 tctatgcagg ggccacaaac tcctcagtca accagcagtt ctatggcaga aggaggagac
3481 ctgaagccac caactccagc atccacacca catagtcaaa ttccccccctt accaggcatg
3541 agcaggagca actcagtcgg aatccaggat gccttctg atggaagtga cccccacattc
3601 cagaagcgga attccatgac tccaaaccct gggtaccagc ccagtatgaa tacctctgac
3661 atgatggggc gcatgtccta tgagccaaat aaggatcctt atgcagcat gaggaaagcc
3721 ccaggaagtg atcccttcat gtcctcaggg cagggcccca atggcgggat gggtgatccc
3781 tacagccgtg ctgctggccc tgggctggga agtgtggcga tgggaccacg gcagcactat
3841 ccctatggag gtccttacga cagagtgagg acggagccgg gaatcgggcc tgaaggaaat
3901 atgggcactg gagcccctca gccaaatctc atgccttcca ccccagattc ggggatgtat
3961 tctcctagcc gctacccccc gcagcagcag cagcaacagc agcaacaaca tgattcctat
4021 ggcaatcaat tctctaccca aggcaccct tccagcagcc cttccccag ccagcagacc
4081 acaatgtatc agcagcagcg cagaattat aagaggccaa tggatgccaa atatggcccc
4141 cctgccaagc ggcatgaagg ggagatgtac agtgtgccgt acagcgctgg gcaaggccag
4201 cctcaacagc agcagttgcc tgcagctcag tcccagcctg ccagccagcc acaagctgcc
4261 cagccttccc ctcagcagga cgtgtacaac cagtacagca atgcctaccc tgcctccgcc
4321 accgctgcta ctgatcgcg accagcaggc ggcccccaga accaatttcc attccagttt
4381 ggcgagacc gagtctctgc acctcctggt tccagtgccc agcagaacat gccaccacaa
4441 atgatggctg ccccatacaa ggcatcagct gaggttgctc agcagggcac catgtggcag
4501 gggcgaaatg acatgaccta caattatgcc aacaggcaga acacaggctc tgccacccag
4561 ggccctgcgt atcatggtgt gaaccgaaca gatgaaatgc tccacacaga tcagggggcc
4621 aaccatgaag gcccatggcc ttcccatggc acgccagc ctccgtatgg tccttcagcc
```

TABLE 1-continued

```
4681 cctgttcccc ccatgacaag gcccctcca tctaactacc agccccacc aagcatgccg
4741 aatcacattc ctcaggtatc cagccccgct ccctcccc ggcccatgga gaaccgtact
4801 tctcctagca agtctccatt cctgcactct gggatgaaaa tgcaaaaggc gggtccaccg
4861 gtgcctgctt cgcacatagc gcctacccct gtgcagcgc ctatgattcg gcgggatatc
4921 accttcccac ctggctctgt agaggccact cagcctgtgt tgaagcagag aaggcggctc
4981 acaatgaaag acattggaac cccggaggca tggcgggtaa tgatgtccct caagtccggg
5041 ctcctggcag agagcacgtg ggcgttagac accattaaca ttctactgta tgatgacaac
5101 agcattatga ccttcaacct cagccagctc ccaggcttgc tagagctcct tgtggaatat
5161 ttccgtagat gcctaattga aatctttggc attttaaagg agtatgaggt agggaccca
5221 ggacagagaa cattactaga ccctgggaga ttcaccaagg tgtatagtcc agcccataca
5281 gaggaagaag aggaagaaca ccttgatcct aaactggagg aggaagagga agaagggtt
5341 ggaaatgatg aggagatggc cttttgggc aaggacaagc atcttcaga gaataatgag
5401 gagaagctag tcagtaagtt tgacaagctt ccggtaaaga tcgtgcagag gaatgaccca
5461 tttgtggtgg actgctcaga taagcttggg cgcgtgcagg agtttgacag tggcctgcta
5521 cactggcgga ttggtgtgg ggataccact gagcatatcc agcccactt tgagagcaag
5581 atagagctgc tgccttcccg gccttatgtg ccctgcccaa cgcccctcg gaaacacctc
5641 acaacagtag agggcacacc agggacaacg gagcaggagg gcccccgcc cgatggcctt
5701 ccagagaaaa ggatcacagc caccatggat gacatgttgt ctacccggtc tagcacattg
5761 actgatgagg ggcaaaagag tgcagaggcc accaaggaaa gcagcaagtt tccatttggc
5821 attagcccag cacagagcca ccggaacatc aaaattttag aggatgaacc ccatagtaag
5881 gatgagaccc cactgtgtac ccttctggac tggcaggatt cccttgctaa gcgctgtgtc
5941 tgtgtctcca ataccatccg gagcctgtcg tttgtgccag gcaacgactt tgagatgtcc
6001 aaacacccag ggctgctgct tatcctgggc aagctgatcc tgctgcacca caagcaccca
6061 gagcggaagc aggcaccact aacttatgag aaggaggagg aacaggacca aggggtgagc
6121 tgtgacaaag tggagtggtg gtgggactgc ttggagatgc tccgagaaaa cacgctggtc
6181 accctcgcca acatctcggg gcaattggac ctatcccat atcctgagag catctgcctg
6241 cctgtcctgg acggactcct acactgggca gtttgccctt cagctgaagc ccaggacccc
6301 ttctcaaccc taggcccaa tgccgtcctc tcccccaga gattggtctt ggaaaccctc
6361 agcaaactca gcatccagga caacaatgtg gacctgatcc tggccactcc ccttttagc
6421 cgcctgagga agttgtatag taccatggtg cgcttcctca gtgaccgaaa gaacccagtg
6481 tgccgggaga tggccgtggt actgctggca aatctgccc aggggacag cctggcagcc
6541 cgggccattg cagtgcagaa gggcagcatc ggcaacctcc tgggttcct ggaggacagc
6601 cttgctgcca cacagttcca gcagagccag gcaagcctcc tgcatatgca gaatccaccc
6661 tttgaaccaa ctagtgtgga catgatgcgg cgggctgccc gagcactgct tgccctggcc
6721 aaggtggatg agaaccactc agagttcact ctgtatgagt cacggctgtt ggacatctcc
6781 gtgtcaccac tgatgaactc attggtttca caagtcattt gtgatgtact gttttgatt
6841 ggccagtcat gacagccgtg ggacacctcc cctcccgtg tgtgtgag tgtgtggaga
6901 acttagaaac tgactgttgc cctttattta tgcaaaacca cctcagaatc cagtttaccc
6961 tgtgctgtcc agcttctccc ttgggaaagc ctctcctgtt ctctctcctc cccaccctca
7021 ctccctcaca cctttctgtt ccccatcctc acctgcttcc ctcaggaccc caccctatt
7081 gaaaagacaa agctctgcct acatagaaga cttttttatt ttaaccaaag ttactgttgt
7141 ttacagtgag tttggggaaa aaaatggctt tcccagtcct tgcatcaacg ggatgccaca
7201 tttcataact gttttaatg gttaaaaaaa aaaaaaaaa aaggaaaaaa aatacaaaaa
7261 aaccctgaag gacaaaggtg actgctgagc tgtgtggttt gtcgctgtcc attcacaatc
7321 tcgcaggagc cgagaagttc gcagttgcga gcagaccctg ttcactggag aggcctgtgc
7381 agtagagtgt agatcctttc atgtactgta ctgtacacct gatactgtaa acatactgta
7441 ataataatgt ctcacatgga aacgagagaa gacgctgggt cagcagcaag ctgtagtttt
7501 taaaaatgtt tttagttaaa tgttgaggag aaaaaaaatg gctttccccc caaagtatcc
7561 tgtgtgaacc tacaacgccc tgacctcttt ctctcctcct tgattgtatg aatagccctg
7621 agatcacctc ttagacctgg ttttaacctt tagctgcagc ggctgcgctg ccacgtcgtt
7681 atatatatga tgttgtacat tgcacatacc cttgaatctc cacagtttgg tccccttccc
7741 agctacccct ttatagtatg gcgagttaac aagttggtga cctgcacaaa gcgagacaca
7801 gctatttaat ctcttgccag acattgcccc tcttggtgca gtgctctaca ggtctctgta
7861 aaaagcccct gctgtctcag cagccaatca acttacagtt tatttttttc tgggttttg
7921 tttgttttg tttcattttct aatcgaggtg tgaaaaagtt ctaggttcag ttgaagttcc
7981 tgatgaagaa acacaattga gatttttca gtgataaaat ctgcatattt gtatttcaac
8041 aatgtagcta aaaacttgat gtaaattcct cctttttttt cctttttgg cttaatgaat
8101 atcattatt cagtatgaaa tctttatact atatgttcca cgtgttaaga ataaatgtac
8161 attaaatctt ggtaa
```

SEQ ID NO: 34 Mouse ARID1A Amino Acid Sequence (NP_001074288.1)
```
   1 maaqvapaaa sslgnppppp selkkaeqqq reeaggeaaa aaaergemka aagqesegpa
  61 vgppqplgke lqdgaesngg gggggagsgg gpgaepdlkn sngnagprpa lnnnlpeppg
 121 gggggssss dgvgapphsa aaalpppayg fgqaygrsps avaaaaaavf hqqhggqqsp
 181 glaalqsggg gglepyagpq qnshdhgfpn hqynsyypnr sayppppqay alssprgtp
 241 gsgaaaaags kpppsssasa sssssfaqq rfgamggggp saagggtpqp tatptlnqll
 301 tspssargyq gypggdyggg pqdggagkgp admasqcwga aaaaaaaaa vsggaqqrsh
 361 hapmspgssg gggqplartp qssspmdqmg kmrpqpyggt npysqqqgpp sgpqqghgyp
 421 gqpygsqtpq rypmtmqqra qsamgslsya qqippygqqq psaygqqgqt pyynqqsphp
 481 qqqppyaqqp psqtphaqps yqqqpqtqqp qlqssqppys qqpsqpphqq sptypsqqs
 541 ttqqhpqsqp pysqpqaqsp yqqqpqqpa ssslsqqaay pqpqpqqsqq taysqqrfpp
 601 pqelsqdsfg sqassapsmt sskggqedmn lslqsrpssl pdlsgsiddl pmgtegalsp
 661 gvstsgisss qgeqsnpaqs pfsphtsphl pgirgpspsp vgspasvaqs rsgplspaav
 721 pgnqmpprpp sgqsdsimhp smnqssiaqd rgymqrnpqm pqytspqpgs alsprqpsgg
 781 nmhsgvgsyq qnsmgsygpq gsqygpqggy prqpnyalp nanypnagma gsmnpmgagg
 841 qmhgqpgipp ygtlppgrma hasmgnrpyg pnmanmppqv gsgmcpppgg mnrktqesav
 901 amhvaansiq nrppgypnmn qggmmgtgpp yqqginsmag minpqgppyp mggtmannsa
 961 gmaaspemmg lgdvkltpat kmnnkadgtp kteskskkss sstttnekit klyelggepe
1021 rkmwvdryla fteekamgmt nlpavgrkpl dlyrlyvsvk eiggltqvnk nkkwrelatn
1081 lnvgtsssaa sslkkqyiqc lyafeckier gedpppdifa aadskksqpk iqppspagsg
```

TABLE 1-continued

```
1141 smqgpqtpqs tsssmaeggd lkpptpasrp hsqipplpgm srsnsvgiqd afpdgsdptf
1201 qkrnsmtpnp gyqpsmntsd mmgrmsyepn kdpygsmrka pgsdpfmssg qgpnggmgdp
1261 ysraagpglg svamgprqhy pyggpydrvr tepgigpegn mgtgapqpnl mpstpdsgmy
1321 spsryppqqq qqqqqhdsy gnqfstqgtp ssspfpsqqt tmyqqqqqny krpmdgtygp
1381 pakrhegemy svpysagqgq pqqqqlpaaq sqpasqpqaa qpspqqdvyn qysnaypasa
1441 taatdrrpag gpqnqfpfqf grdrvsappg ssaqqnmppq mmggpiqasa evaqqgtmwq
1501 grndmtynya nrqntgsatq gpayhgvnrt demlhtdqra nhegpwpshg trqppygpsa
1561 pvppmtrppp snyqpppsmp nhipqvsspa plprpmenrt spskspflhs gmkmqkagpp
1621 vpashiaptp vqppmirrdi tfppgsveat qpvlkqrrrl tmkdigtpea wrvmmslksg
1681 llaestwald tinillyddn simtfnlsql pgllellvey frrclieifg ilkeyevgdp
1741 gqrtlldpgr ftkvyspaht eeeeeehldp kleeeeeegv gndeemaflg kdkpssenne
1801 eklvskfdkl pvkivqrndp Iwdcsdklg rvqefcdsgll hwrigggdtt ehiqthfesk
1861 iellpsrpyv pcptpprkhl ttvegtpgtt eqegpppdgl pekritatmd dmlstrsstl
1921 tdegaksaea tkesskfpfg ispaqshrni kiledephsk detplctlld wqdslakrcv
1981 cvsntirsls fvpgndfems khpglllilg klillhhkhp erkqapltye keeeqdqvs
2041 cdkvewwwdc lemlrentlv tlanisgqld lspypesicl pvldgllhwa vcpsaeaqdp
2101 fstlgpnavl spqrlvletl sklsiqdnnv dlilatppfs rleklystmv rflsdrknpv
2161 cremavvlla nlaqgdslaa raiavqkgsi gnllgfleds laatqfqqsq asllhmqnpp
2221 feptsvdmmr raarallala kvdenhseft lyesrlldis vsplmnslvs qvicdvlfli
2281 gqs
```

SEQ ID NO: 35 Human ARID1B cDNA Sequence Variant (NM_017519.2, CDS: from 1 to 6711)

```
   1 atggcccata acgcgggcgc cgcggccgcc gccggcaccc acagcgccaa gagcggcggc
  61 tccgaggcgg ctctcaagga gggtggaagc gccgccggcc tgtcctcctc ctcctcctcc
 121 tccgcggcgg cagcggcggc atcctcttcc tcctcgtcgg gcccgggctc ggccatggag
 181 acggggctgc tccccaacca caaactgaaa accgttggcg aagcccccgc cgcgccgccc
 241 caccagcagc accaccacca ccaccatgcc caccaccacc accaccatgc ccaccacctc
 301 caccaccacc acgcactaca gcagcagcta aaccagttcc agcagcagca gcagcagcag
 361 caacagcagc agcagcagca gcagcaacag caacatccca tttccaacaa caacagcttg
 421 ggcgcgcgg gcggcggcgc gcctcagccc ggccccgaca tggagcagcc gcaacatgga
 481 ggcgccaagg acagtgctgc gggcggccag gccgacccc gggcccgcc gctgctgagc
 541 aagccgggcg acgaggacga cgcgccgccc aagatggggg agccggcggg cggccgctac
 601 gagcaccggg gcttgggcgc cctgggcacg cagcagccgc cggtcgccgc gccggggggc
 661 ggcggcggcc cggcggccgt cccggagttt aataattact atggcagcgc tgcccctgcg
 721 agcggcggcc ccggcggccg cgctgggcct tgctttgatc aacatggcgg acaacaaagc
 781 cccgggatgg ggatgatgca ctccgcctcc gccgccgccg ccggggcccc cggcagcatg
 841 gaccccctgc agaactccca cgaagggtac cccaacagcc agtgcaacca ttatccggcc
 901 tacagccggc ccggcgcggg cggcggcggc ggcggcggcg gcggaggagg aggaggcagc
 961 ggaggaggag gaggaggagg aggagcagga gcaggaggag caggagcggg agctgtggcg
1021 gcggcggccg cggcggcggc ggcagcagca ggaggcggcg gcggcggcgg ctatggggc
1081 tcgtccgcgg ggtacggggt gctgagctcc ccccggcagc agggcgggcg catgatgacg
1141 ggccccgggg gcggcggggc cgcgagcctc agcaaggcgg ccgccggctc ggcggcgggg
1201 ggcttccagc gcttcgccgg ccagaaccag cacccgtcgg gggccacccc gaccctcaat
1261 cagctgctca cctcgcccag ccccatgatg cggagctacg gcggcagcta ccccgagtac
1321 agcagcccca gcgcgccgcc gccgccgccg tcgcagccc agtccagcc ggcggcgggg
1381 ggggcggcgg cgggcggcca gcaggcggcc gcgggcatgg gcttgggcaa ggacatgggc
1441 gcccagtacg ccgctgccag cccggcctgg gcggccgcgc aacaaaggag tcaccgggcg
1501 atgagccccg gcaccccgg accgaccatg ggcagatccc agggcagccc aatggatcca
1561 atggtgatga agagacctca gttgtatggc gtgggcagta accctcattc tcagcctcag
1621 cagagcagtc cgtacccagg aggttcctat ggccctccag gcccacagcg gtatccaatt
1681 ggcatccagg gtcggactcc cggggccatg gccggaatgc agtaccctca gcagcagatg
1741 ccactcagt atggacagca aggtgtgagt ggttactgcc agcagggcca acagccatat
1801 tacagccagc agccgcagcc cccgcacctc ccaccccagg cgcagtatct gccgtcccag
1861 tcccagcaga ggtaccagcc gcagcaggac atgtctcagg aaggctatgg aactagatct
1921 caacctcctc tggccccccgg aaaacctaac catgaagact gaaacttaat acagcaagaa
1981 agaccatcaa gtttaccaga tctgtctggc tccattgatg acctccccac gggaacggaa
2041 gcaactttga gctcagcagt cagtgcatcc gggtccacga gcagccaagg ggatcagagc
2101 aaccccggcgc agtcgccttt cccccccacat gcgtcccctc atctctccag catcccgggg
2161 ggcccatctc cctctcctgt tggctctcct gtaggaagca accagtctcg atctggccca
2221 atctctcctg caagtatccc aggtagtcag atgcctccgc agccacccgg gagccagtca
2281 gaatccagtt cccatcccgc cttgagccag tcaccaatgc cacaggaaag aggttttatg
2341 gcaggcacac aaagaaaccc tcagatggcc cagtatggac ctcaacagac aggaccatcc
2401 atgtcgcctc atccttctcc tgggggccag acgcatgctg gaatcagtga ctttcagcag
2461 agtaactcaa gtgggactta cggtccacag atgagccagt atgaccaca aggtaactac
2521 tccagacccc cagcgtatag tggggtgccc agtgcaagct acagcggccc agggcccggt
2581 atgggtatca gtgccaacaa ccagatgcat ggacaaggc caagccagcc atgtggtgct
2641 gtgccccctgg gacgaatgcc atcagctggg atgcagaaca gaccatttcc tggaaaatatg
2701 agcagcatga ccccccagttc tcctggcatg tctcagcagg gagggccagg aatggggccg
2761 ccaatgccaa ctgtgaaccg taaggcacag gaggcagccg cagcagtgat gcaggctgct
2821 gcgaactcag cacaaagcag gcaaggcagt ttccccgca tgaaccagag tgactttatg
2881 gcttccagct ctccctacag ccagcccatg aacaacagct ctagcctgat gaacacgcat
2941 gcgccgccct acagcatggc gcccgccatg gtgaacagct cggcagcatc tgtgggtct
3001 gcagatatga tgtctcctgt tgaatcccaaa ctgcccctgc ctctcaaagc agacggcaaa
3061 gaagaaggca ctccacagcc cgagacgcaag tcaaagacg ccagtcctc caccactact
3121 gggagagaga tcacgaaggt gtacgagctg ggaatgagc cagagagaaa gctctgggtc
3181 gaccgatacc tcaacttcat ggaagagaga ggctctcctg tctcaagtct gctgccgtg
3241 ggcaagaagc ccctggacct gttccgactc tacgtctgcg tcaaagagat cggggggtttg
3301 gcccaggtta ataaaaacaa gaagtggcgt gagctggcaa ccaacctaaa cgttggcacc
3361 tcaagcagtg cagcggagctc cctgaaaaag cagtatattc agtacctgtt tgcctttgag
```

TABLE 1-continued

```
3421 tgcaagatcg aacgtgggga ggagccccg ccggaagtct tcagcaccgg ggacaccaaa
3481 aagcagccca agctccagcc gccatctcct gctaactcgg gatccttgca aggcccacag
3541 acccccagt caactggcag caattccatg gcagaggttc caggtgacct gaagccacct
3601 accccagcct ccacccctca cggccagatg atccaatgc aaggtggaag aagcagtaca
3661 atcagtgtgc acgacccatt ctcagatgtg agtgattcat ccttcccgaa acggaactcc
3721 atgactccaa acgcccccta ccagcagggc atgagcatgc ccgatgtgat gggcaggatg
3781 ccctatgagc ccaacaagga ccccttggg ggaatgagaa aagtgcctgg aagcagcgag
3841 cccttatga cgcaaggaca gatgcccaac agcagcatgc aggacatgta caaccaaagt
3901 ccctccggag caatgtctaa cctgggcatg gggcagcgcc agcagtttcc ctatggagcc
3961 agttacgacc gaaggcatga accttatggg cagcagtatc caggccaagg ccctccctcg
4021 ggacagccgc cgtatggagg gcaccagccc ggcctgtacc cacagcagcc gaattacaaa
4081 cgccatatgg acggcatgta cgggccccca gccaagcgcc acgagggcga catgtacaac
4141 atgcagtaca gcagccagca gcaggagatg tacaaccagt atggaggctc ctactcgggc
4201 ccggaccgca ggcccatcca gggccagtac ccgtatccct acagcaggga gaggatgcag
4261 ggcccggggc agatccagac acacggaatc ccgcctcaga tgatgggcgg cccgctgcag
4321 tcgtcctcca gtgagggcc tcagcagaat atgtgggcag cacgcaatga tatgccttat
4381 ccctaccaga acaggcaggg ccctggcggc cctacacagg cgccccctta cccaggcatg
4441 aaccgcacag acgatatgat ggtacccgat cagaggataa atcatgagag ccagtggcct
4501 tctcacgtca gccagcgtca gccttatatg tcgtcctcag cctccatgca gcccatcaca
4561 cgcccaccac agccgtccta ccagacgcca ccgtcactgc caaatcacat ctccagggcg
4621 cccagcccag cgtccttcca gcgctccctg gagaaccgca tgcctccaag caagtctcct
4681 tttctgccgt ctatgaagat gcagaaggtc atgcccacg tccccacatc ccaggtcacc
4741 gggccaccac ccaaccacc cccaatcaga agggagatca cctttcctcc tggctcagta
4801 gaagcatcac aaccagtctt gaaacaaagg cgaaagatta cctccaaaga tatcgttact
4861 cctgaggcgt ggcgtgtgat gatgcccctc aaatcaggtc ttttggctga gagtacgtgg
4921 gctttggaca ctattaatat tcttctgtat gatgacagca ctgttgctac tttcaatctc
4981 tcccagtgt ctggatttcc cgaacttta gtcgagtact ttagaaaatg cctgattgac
5041 attttggaa ttcttatgga atatgaagtg ggagacccca gccaaaagc acttgatcac
5101 aacgcagcaa ggaaggatga cagccagtcc ttggcagacg attctgggaa agaggaggaa
5161 gatgctgaat gtattgatga cgacgaggaa gacgaggagg atgaggagga agacagcgag
5221 aagacagaaa gcgatgaaaa gagcagcatc gctctgactg ccccggacgc cgctgcagac
5281 ccaaaggaga agcccaagca agccagtaag ttcgacaagc tgccaataaa gatagtcaaa
5341 aagaacaacc tgtttgttgt tgaccgatct gacaagttgg ggcgtgtgca ggagttcaat
5401 agtggccttc tgcactggca gctcggcggg ggtgacacca ccgagcacat tcagactcac
5461 tttgagagca agatggaaat tcctcctcgc aggcgcccac ctccccctt aagctccgca
5521 ggtagaaaga aagagcaaga aggcaaagc gactctgaag agcagcaaga gaaaagcatc
5581 atagcaacca tcgatgacgt cctctctgct cggccagggg cattgcctga gacgcaaac
5641 cctgggcccc agaccgaaag cagtaagttt ccctttggta tccagcaagc caaaagtcac
5701 cggaacatca agctgctgga ggacgagccc aggagccgag acgagactcc tctgtgtacc
5761 atcgcgcact ggcaggactc gctggctaag cgatgcatct gtgtgtccaa tattgtccgt
5821 agcttgtcat tcgtgcctgg caatgatgcc gaaatgtcca acatccagg cctggtgctg
5881 accctgggga agctgattct tcttcaccac gatcatccag agagaaagcg agcaccgcag
5941 acctatgaga aagaggagga tgaggacaag gggtggcct gcagcaaaa tgagtggtgg
6001 tgggactgcc tcgaggtcct gagggataac acgttggtca cgctggccaa catttccggg
6061 cagctagact tgtctgctta cacggaaagc atctgcttgc caattttgga tggcttgctg
6121 cactggatgg tgtgcccgtc tgcagaggca caagatccct ttccaactgt gggaccaac
6181 tcggtcctgt cgcctcagag acttgtgctg gagaccctct gtaaactcag tatccaggac
6241 aataatgtgg acctgatctt ggccactcct ccatttagtc gtcaggagaa attctatgct
6301 acattagtta ggtacgttgg ggatcgcaaa aacccagtct gtcgagaaat gtccatggcg
6361 cttttatcga accttgccca agggacgca ctagcagcaa gggccatagc tgtgcagaaa
6421 ggaagcattg gaaacttgat aagcttccta gaggatgggg tcacgatggc ccagtaccag
6481 cagagccagc acaacctcat gcacatgcag ccccccgcccc tggaaccacc tagcgtagac
6541 atgatgtgca gggcggccaa ggctttgcta gccatggcca gagtggacga aaaccgctcg
6601 gaattccttt tgcacgaggg ccggttgctg gatatctgta tatcagctgt cctgaactct
6661 ctggttgcat ctgtcatctg tgatgtactg tttcagattg ggcagttatg acataagtga
6721 gaaggcaagc atgtgtgagt gaagattaga gggtcacata taactggctg ttttctgttc
6781 ttgttatcc agcgtaggaa gaaggaaaag aaaatctttg ctcctctgcc ccattcacta
6841 tttaccaatt gggaattaaa gaaataatta atttgaacag tcatgaaatt aatatttgct
6901 gtctgtgtgt ataagtacat cctttgggt ttttttttc tctctttt aaccaaagtt
6961 gctgtctagt gcattcaaag gccactttt gttcttcaca gatctttta atgttctttc
7021 ccatgttgta ttgcattttt gggggaagca aattgacttt aaagaaaaaa gttgtggcaa
7081 aagatgctaa gatgcgaaaa tttcaccaca ctgagtcaaa aaggtgaaaa attatccatt
7141 tcctatgcgt tttactcctc agagaatgaa aaaaactgca tcccatcacc caaagttctg
7201 tgcaatagaa atttctacag atacaggtat aggggctcaa ggaggtatgt cggtcagtag
7261 tcaaaactat gaaatgatac tggtttctcc acaggaatat ggttccatta ggctgggagc
7321 aaaaacaatg tttttaaga ttgagaatac atacctgaca acgatccgga aactgctcct
7381 caccactccc gtcatgcctg ctgtcgggcgt ttgaccttcc acgtgacagt tcttcacaat
7441 tcctttcatc atttttaaa tatttttttt actgcctatg ggctgtgatg tatatagaag
7501 ttgtacatta aacataccct cattttttc ttttcttttt tttttttttt tttagtacaa
7561 agtttagtt tcttttcat gatgtggtaa ctacgaagtg atggtagatt taaataattt
7621 tttattttta ttttatatat tttttcatta ggccacatc tccaaaaaa gaagagaaaa
7681 atacaaaaaa caaaacaaa aaaaaagag ggtaatgtac aagtttctgt atgtataaag
7741 tcatgctcga tttcaggaga gcagctgatc acaatttgct tcatgaatca aggtgtggaa
7801 atggttatat atggattgat ttagaaaatg gttaccagta cagtcaaaaa agagaaaatg
7861 aaaaaaatac aactaaaagg aagaaacaca acttcaaaga tttttcagtg atgagaatcc
7921 acatttgtat ttcaagataa tgtagtttaa aaaaaaaaaa aagaaaaaaa cttgatgtaa
7981 attcctcctt ttcctctggc ttaatgaata tcatttattc agtataaaat ctttatatgt
8041 tccacatgtt aagaataaat gtacattaaa tcttgttaag cactgtgatg ggtgttcttg
8101 aatactgttc tagtttcctt aaagtggttt cctagtaatc aagttattta caagaaatag
8161 gggaatgcag cagtgtattc acattataaa accctacatt tggaagagac ctttagggt
```

TABLE 1-continued

```
8221  tacctacttt  agagtgggga  gcaacagttt  gattttctca  aattacttag  ctaattagtc
8281  tttcttcgaa  gcaattaact  ctaacgacat  tgaggtatga  tcattttcag  tatttatggg
8341  aggtggctgc  tgacccactt  gaggtgagat  ctcagaagct  taactggcct  gaaaatgtaa
8401  cattctgcct  tttactaact  ccatcttagt  ttaatcaaag  ttcaatctat  tccttgtttc
8461  ttctgtgtgc  ctcagagcta  ttttgcattt  agtttactcc  accgtgtata  atatttatac
8521  tgtgcaatgt  taaaaaagaa  tctgttatat  tgtatgtggt  gtacatagtg  caaagtgatg
8581  atttctatct  cagggcatat  tatggtcctc  atattccttc  ctacctggtg  cacagtagct
8641  ttttaatact  agtcacttct  aatttaaact  ttctcttcct  gggtcattga  ctgttactgt
8701  gtaataatcg  atttctttga  aactgctgca  taattatgct  gttagtggac  ctctacctct
8761  tctcttccct  ctcccaatca  cagtatactc  agaatcccca  gcccctcgca  tacattgtgt
8821  cggttcacat  tactcacagt  aatatatgga  agagttagac  aagaacatgc  agttacagtc
8881  attgtgagac  gtgactctcc  agtgtcacga  ggaaaaaaat  catctttttct  gcaaacagtc
8941  tctcatctgt  caactcccac  attactgagt  caaacagtct  tcttacataa  caatgcaacc
9001  aaatatatgt  tgaattaaag  acccatttat  aattctgctt  taaacacatc  tgcttgctaa
9061  gaacagattt  cagtgctcca  agcttcaaat  atggagattt  gtaagaggga  attcaatatt
9121  attctaattt  ctctcttaca  gagtacaaat  aaaaggtgta  tacaaactcc  gaacatatcc
9181  agtattccaa  ttccttttgtc  aatcagaaga  gtaaaataat  taacaaaaga  ctgttgttat
9241  ggtttgcatt  gtaaccgata  cgcagagtct  gaccgttggg  caacaagttt  ttctatcctg
9301  atgcgcaaca  cagtctctag  agactaatcc  aggaagactt  tagcctcctt  tccatattct
9361  cacccccgaa  tcaagattta  cagaagccca  cgaagaattt  acagcctgct  tgagatcatc
9421  ttgcctataa  actgagttat  tgctttgtcc  taaaaattag  tcggtttttt  tttttctatg
9481  aggcttttca  gaaatttaca  ggatgcccag  actttacatg  tgtaccaaaa  aaaaaaaaaa
9541  gataaaaaat  aaaggtgcaa  agaaagttta  gtattttgga  atggtgctat  aaagttgaaa
9601  aaaaaaaa
```

SEQ ID NO: 36 Human ARID1B Amino Acid Sequence isoform A (NP_059989.2)

```
   1  mahnagaaaa  agthsaksgg  seaalkeggs  aaalsssssss  saaaaaasss  sssgpgsame
  61  tgllpnhklk  tvgeapaapp  hqqhhhhhha  hhhhhhahhl  hhhhalqqql  nqfqqqqqqq
 121  qqqqqqqqq   qhpisnnnsl  ggagggapqp  gpdmeqpqhg  gakdsaaggq  adppgpplls
 181  kpgdeddapp  kmgepaggry  ehpglgalgt  qqppvavpgg  gggpaavpef  nnyygsaapa
 241  sggpggragp  cfdqhggqqs  pgmgmmhsas  aaaagapgsm  dplqnshegy  pnsqcnhypg
 301  ysrpgaggg   ggggggggs   ggggggggag  aggagagava  aaaaaaaaaa  gggggggygg
 361  ssagygvlss  prqqgggmmm  gpgggggaasl skaaagsaag  gfqrfaggnq  hpsgatptln
 421  qlltspspmm  rsyggsypey  sspsapppp   sqpqsqaaaa  gaaagqqaa   agmglgkdmg
 481  aqyaaaspaw  aaaqqrshpa  mspgtpgptm  grsqgspmdp  mvmkrpqlyg  mgsnphsqpq
 541  qsspypggsy  gppgpqrypi  giqgrtpgam  agmqypqqqm  ppqygqqgvs  gycqqgqqpy
 601  ysqqpqpphl  ppqaqylpsq  sqqryqpqqd  msqegygtrs  qpplapgkpn  hedlnliqqe
 661  rpsslpdlsg  siddlptgte  atlssavsas  gstssqqdqs  npaqspfsph  asphlssipg
 721  gpspspvgsp  vgsnqsrsgp  ispasipgsq  mppqppgsqs  essshpalsq  spmpqergfm
 781  agtqrnpqma  qygpqqtgps  msphpspggq  mhagissfqq  snssgtygpq  msqygpqgny
 841  srppaysgvp  sasysgpgpg  mgisannqmh  gqgpsqpcga  vplgrmpsag  mqnrptpgnm
 901  ssmtpsspgm  sqqggpgmgp  pmptvnrkaq  eaaaavmqaa  ansaqsrqgs  fpgmnqsglm
 961  assspysqpm  nnssslmntq  appysmapam  vnssaasvgl  admmspgesk  lplplkadgk
1021  eegtpqpesk  skkssssttt  gekitkvyel  gneperklwv  dryltfmeer  gspvsslpav
1081  gkkpldlfrl  yvcvkeiggl  aqvnkkkwr   elatnlnvgt  sssaasslkk  qyiqylfafe
1141  ckiergeepp  pevfstgdtk  kqpklqppsp  ansgslqgpq  tpqstgsnsm  aevpgdlkpp
1201  tpastphgqm  tpmqggrsst  isvhdpfsdv  sdssfpkrns  mtpnapyqqg  msmpdvmgrm
1261  pyepnkdpfg  gmrkvpgsse  pfmtqgqmpn  ssmqdmynqs  psgamsnlgm  gqrqqfpyga
1321  sydrrhepyg  qqypgqgpps  gqppyggqhqp  glypqqpnyk  rhmdgmygpp  akrhegdmyn
1381  mqyssqqqem  ynqyggsysg  pdrrpiqgqy  pypysrermq  gpgqiqthgi  ppqmmpgglq
1441  ssssegpqqn  mwaarndmpy  pyqnrqgpgg  ptqappypgm  nrtddmmvpd  qrinhesqwp
1501  shvsqrqpym  sssasmqpit  rppqpsyqtp  pslpnhisra  pspasfqrsl  enrmspsksp
1561  flpsmkmqkv  mpsvptsqvt  gpppqpppir  reitfppgsv  easqpvlkqr  rkitskdivt
1621  peawrvmmsl  ksgllaestw  aldtinilly  ddstvatfnl  sqlsgflell  veyfrkclid
1681  ifgilmeyev  gdpsqkaldh  naarkddsqs  laddsgkeee  daecidddee  deedeeedse
1741  ktesdekssi  altapdaaad  pkekpkqask  fdklpikivk  knnlfvvdrs  dklgrvqefn
1801  sgllhwqlgg  gdttehiqth  feskmeippr  rrppppplssa grkkeqegkg  dseeqqeksi
1861  iatiddvlsa  rpgalpedan  pgpqtesskf  pfgiqqaksh  rniklledep  rsrdetplct
1921  iahwqdslak  rcicvsnivr  slsfvpgnda  emskhpglvl  ilgkllillhh  ehperkrapq
1981  tyekeededk  gvacskdeww  wdclevlrdn  tlvtlanisg  qldlsaytes  iclpildgll
2041  hwmvcpsaea  qdpfptvgpn  svlspqrlvl  etlcklsiqd  nnvdlilarp  pfsrqekfya
2101  tlvryvgdrk  npvcremsma  llsnlaqgda  laaraiavqk  gsignlisfl  edgvtmaqyq
2161  qsqhnlmhmq  pppleppsvd  mmcraakall  amarvdenrs  efllhegrll  disisavlns
2221  lvasvicdvl  fqigql
```

SEQ ID NO: 37 Human ARID1B cDNA Sequence Variant 2 (NM_020732.3. CDS: from 1 to 6750)

```
   1  atggcccata  acgcgggcgc  cgcggccgcc  gccggcaccc  acagcgccaa  gagcggcggc
  61  tccgaggcgg  ctctcaagga  gggtgaagc   gccgccgcgc  tgtcctcctc  ctcctcctcc
 121  tccgcggcgg  cagcggcggc  atcctcttcc  tcctcgtcgg  gcccgggctc  ggccatggag
 181  acggggctgc  tccccaacca  caaactgaaa  acggttggc   aagcccccgc  cgcgccgcc
 241  caccagcagc  accaccacca  ccaccatgcc  caccaccacc  accaccatgc  ccaccaccc
 301  caccaccacc  acgcactaca  gcagcagcta  aaccagttcc  agcagcagca  gcagcagcag
 361  caacagcagc  agcagcagca  gcagcaacag  caacatccca  tttccaacaa  caacagcttg
 421  ggcggcgggg  gcggcggcgg  gcctcagcc   gccccacagc  cggagcagcc  gcaacatgga
 481  ggcgccaagg  acagtgctgc  gggcggccag  gccgaccccc  cggggccgc   gccgctgagc
 541  aagccggcg   acgaggacga  cgcgccgcc   aagatggggg  agccggcgg   cggccgctac
 601  gagcacccgg  gcttgggcgc  cctgggcacg  cagcagccgc  cggtcgccgt  gcccgggggc
 661  ggcggcgcc   cggcggccgt  cccggagttt  aataactact  atggcagcgc  tgcccctgcg
 721  agcggcggcc  ccggcggccg  cgctgggcct  tgctttgatc  aacatggcgg  acaacaaagc
```

TABLE 1-continued

```
 781 cccgggatgg ggatgatgca ctccgcctcc gccgccgccg ccggggcccc cggcagcatg
 841 gacccctgc agaactccca cgaagggtac cccaacagcc agtgcaacca ttatccgggc
 901 tacagccggc ccggcgcggg cggcggcggc ggcggcggcg cggaggagg aggaggcagc
 961 ggaggaggag gaggaggagg aggagcagga gcaggaggag caggagcggg agctgtggcg
1021 gcggcggccg cggcggcggc ggcagcagca ggaggcgccg gcggcggcgc ctatgggggc
1081 tcgtccgcgg ggtacggggt gctgagctcc ccccggcagc agggcggcgg catgatgatg
1141 ggccccgggg gcggcggggc cgcgagcctc agcaaggcgg ccgccggctc ggcggcgggg
1201 ggcttccagc gcttcgccgg ccagaaccag cacccgtcgg gggccaccc gaccctcaat
1261 cagctgctca cctcgcccag cccatgatg cggagctacg gcggcagcta ccccgagtac
1321 agcagcccca gcgcgccgcc gccgccgccg tcgcagcccc agtcccaggc ggcggcggcg
1381 ggggcggcgg cgggcggcca gcaggcggcc gcgggcatgg gcttgggcaa ggacatgggc
1441 gcccagtacg ccgctgccag cccggcctgg gcggccgcgc aacaaaggag tcacccggcg
1501 atgagcccgg gcacccccgg accgaccatg ggcagatccc agggcagccc aatggatcca
1561 acggtgatga agagacctca gttgtatggc atgggcagta accctcattc tcagcctcag
1621 cagagcagtc cgtacccagg aggttcctat ggccctccag gcccacagcg gtatccaatt
1681 ggcatccagg gtcggactcc cggggccatg gccggaatgc agtaccctca gcagcaggac
1741 tctggagatg ccacatggaa agaaacattc tggttgatgc cacctcagta tggacagcaa
1801 ggtgtgagtg gttactgcca gcagggccaa cagccatatt acagccagca gccgcagccc
1861 ccgcacctcc caccccaggc gcagtatctg ccgtcccagt cccagcagag gtaccagccg
1921 cagcaggaca tgtctcagga aggctatgga actagatctc aacctcctct ggcccccgga
1981 aaacctaacc atgaagactt gaacttaata cagcaagaaa gaccatcaag tttaccagat
2041 ccgtctggct ccattgatga cctccccacg ggaacggaag caactttgag ctcagcagtc
2101 agtgcatccg ggtccacgag cagccaaggg gatcagagca acccggcgca gtcgcctttc
2161 tccccacatg cgtcccctca tctctccagc atcccggggg gcccatctcc ctctcctgtt
2221 ggctctcctg taggaagcaa ccagtctcga tctggcccaa tctctcctgc aagtatccca
2281 ggtagtcaga tgcctccgca gccacccggg agcccagtcag aatccagttc ccatcccgcc
2341 ttgagccagt caccaatgcc acaggaaaga ggttttatgg caggcacaca aagaaaccct
2401 cagatggctc agtatggacc tcaacagaca ggaccatcca tgtcgcctca tccttctcct
2461 gggggccaga tgcatgctgg aatcagtagc tttcagcaga gtaactcaag tgggacttac
2521 ggtccacaga tgagccagta tggaccacaa ggtaactact ccagaccccc agcgtatagt
2581 ggggtgccca gtgcaagcta cagcggccca gggcccggta tgggtatcag tgccaacaac
2641 cagatgcatg gacaagggcc aagccagcca tgtggtgctg tgccctggg acgaatgcca
2701 tcagctggga tgcagaacag accatttcct ggaaatatga gcagcatgac cccagttct
2761 cctggcatgt ctcagcaggg agggccagga atggggccag caatgccaac tgtgaaccgt
2821 aaggcacagg aggcagccgc agcagtgatg caggctgctg cgaactcagc acaaagcagg
2881 caaggcagtt tccccggcat gaaccagagt ggacttatg cttccagctc tccctacagc
2941 cagcccatga acaaacagctc tagcctgatg aacacgcagg cgccgcccta cagcatgcgc
3001 cccgccatgg tgaacagctc ggcagcatct gtgggtcttg cagatatgat gtctcctggt
3061 gaatccaaac tgccctgcc tctcaaagca gacggcaaag aagaaggcac tccacagccc
3121 gagagcaagt caaagagtc cagctcctcc accactactg gggagaagat cacgaaggtg
3181 tacgagctgg ggaatgagcc agagagaaag ctctgggtcg accgatacct caccttcatg
3241 gaagagagag gctctcctgt ctcaagtctg cctgccgtgg gcaagaagcc ctccagccg
3301 ttccgactct acgtctgcgt caaagagatc ggggggtttgg cccaggttaa taaaaacaag
3361 aagtggcgtg agctggcaac caacctaaac gttggcacct caagcagtgc agcgagctcc
3421 ctgaaaaagc agtatattca gtacctgttt gcctttgagt gcaagatcga acgtggggag
3481 gagccccgc cggaagtctt cagcaccggg cacaccaaaa agcagccaa gctccagccg
3541 ccatctcctg ctaactcggg atccttgcaa ggccacagaa cccccagtc aactggcagc
3601 aattccatgg cagaggttcc aggtgacctg aagccaccta ccccagcctc caccctcac
3661 ggccagatga ctccaatgca aggtggaaga agcagtacaa tcagtgtgca cgacccattc
3721 tcagatgtga gttgatcatc cttcccgaaa cggaactcca tgactccaaa cccgcccctac
3781 cagcagggca tgagcatgcc cgatgtgatg ggcaggatgc cctatgagcc caacaaggac
3841 cccttgggg gaatgagaaa agtgcctgga agcagcgagc cttttatgac gcaaggacag
3901 atgcccaaca gcagcatgca ggacatgtac aaccaaagtc cctccggagc aatgtctaac
3961 ctgggcatgg ggcagcgcca gcagtttccc tatggagcca gttacgaccg aaggcatgaa
4021 ccttatgggc agcagtatcc aggccaaggc cctccctcgg gacagccgcc gtatgcaggg
4081 caccagcccg gcctgtaccc acagcagccg aattacaaac gccatatgga cggcatgtac
4141 gggcccccag ccaagcgcca cgagggcgac atgtacaaca tgcagtacag cagccagcag
4201 caggagatgt acaaccagta tggaggctcc tactcgggcc cggaccgcag gcccatccag
4261 ggccagtacc cgtatcccta cagcagggag aggatgcagg gcccgggca gatccagaca
4321 cacggaatcc cgcctcagat gatgggcggc ccgctgcagt cgtcctccag tgagggcct
4381 cagcagaata tgtgggcagc acgcaatgat atgccttatc cctaccagaa caggcagggc
4441 cctggcggcc ctacacaggc gccccttac ccaggcatga accgcacaga cgatatgatg
4501 gtacccgatc agaggataaa tcatgagagc cagtggcctt ctcacgtcag ccagcgtcag
4561 ccttatatgt cgtcctcagc ctccatgcag cccatccact gcccaccaca gccgtcctac
4621 cagacgccac cgtcactgcc aaatcacacc tccagggcgc ccagcccagc gtccttccag
4681 cgctccccgg agaaccgcat gtccaagc aagtctcctt ttctgccgtc tatgaagatg
4741 cagaaggtca tgcccacggt ccccacatcc cagttcaccg ggccaccacc ccaaccaccc
4801 ccaatcagaa gggagatcac ctttcctcct ggctcagtag aagcatcaca accagtcttg
4861 aaacaaaggc gaaagattac ctccaaagat atcgttactc ctgaggcgtg gcgtgtgatg
4921 atgtcccctta aatcaggtct tttggctgag agtacgtggg ctttggacac tactaatatt
4981 cttctgtatg atgacacgac tgttgctact ttcaatctct cccagttgtc tggatttctc
5041 gaacttttag tcgagtactt tagaaaatgc ctgattgaca tttttggaat tcttatggaa
5101 tatgaagtgg gagacccccag ccaaaaagca cttgatcaca acgcagcaag gaaggatgac
5161 agccagtcct ggcagacga ttctgggaaa gaggaggaag atgctgaatg tattgatgac
5221 gacgaggaag acgaggaggg tgaggaggaa ggagacgaaa gagagaaaag cgatgaaaag
5281 agcagcatcg ctctgactgc cccggacgcc gctgcagacc caaaggagaa gcccaagcaa
5341 gccagtaagt tcgacaagct gccaataaag atagtcaaaa agaacaacct gtttgttgtt
5401 gaccgatctg acaagttggg gcgtgtgcag gagttcaata gtggccttct gcactggcag
5461 ctcggcgggg gtgacaccac cgagcacatt cagactcact ttgagcagcaa gatggaaatt
5521 cctcctcgca ggcgcccacc tcccccctta agctccgcag gtagaaagaa agagcaagaa
```

TABLE 1-continued

```
5581  ggcaaaggcg actctgaaga gcagcaagag aaaagcatca tagcaaccat cgatgacgtc
5641  ctctctgctc ggccaggggc attgcctgaa gacgcaaacc ctgggcccca gaccgaaagc
5701  agtaagtttc cctttggtat ccagcaagcc aaaagtcacc ggaacatcaa gctgctggag
5761  gacgagccca ggagccgaga cgagactcct ctgtgtacca tcgcgcactg gcaggactcg
5821  ctggctaagc gatgcatctg tgtgtccaat attgtccgta gcttgtcatt cgtgcctggc
5881  aatgatgccg aaatgtccaa acatccaggc ctggtgctga tcctggggaa gctgattctt
5941  cttcaccacg agcatccaga gagaaagcga gcaccgcaga cctatgagaa agaggaggat
6001  gaggacaagg gggtggcctg cagcaaagat gagtggtggt gggactgcct cgaggtcttg
6061  agggataaca cgttggtcac gttggccaac atttccgggc agctagactt gtctgcttac
6121  acggaaagca tctgcttgcc aatttggat ggcttgctgc actggatggt gtgcccgtct
6181  gcagaggcac aagatcccctt tccaactgtg ggacccaact cggtcctgtc gcctcagaga
6241  cttgtgctgg agaccctctg taaactcagt atccaggaca ataatgtgga cctgatcttg
6301  gccactcctc catttagtcg tcaggagaaa ttctatgcta cattagttag gtacgttggg
6361  gatcgcaaaa acccagtctg tcgagaaatg tccatggcgc ttttatcgaa ccttgcccaa
6421  ggggacgcac tagcagcaag ggccatagct gtgcagaaag aagccattgg aaacttgata
6481  agcttcctag aggatggggt cacgatggcc cagtaccagc agagccagca caacctcatg
6541  cacatgcagc ccccgccctt ggaaccacct agcgtagaca tgatgtgcag ggcggccaag
6601  gctttgctag ccatggccag agtggacgaa aaccgctcgg aattccttttt gcacgagggc
6661  cggttgctgg acatctcgat atcagctgcc ctgaactctc tggttgcatc tgtcatctgt
6721  gacgtactgt ttcagattgg gcagttatga cataagtgag aaggcaagca tgtgtgagtg
6781  aagattagag ggtcacatat aactggctgt tttccgttct tgtttatcca gctaggaag
6841  aaggaaaaga aaatctttgc tcctctgccc cattcactat ttaccaattg ggaattaaag
6901  aaataattaa tttgaacagt tatgaaatta atatttgctg tctgtgtgta taagtacatc
6961  cttttgggtt ttttttttct ctttttttta accaaagttg ctgtctagtg cattcaaagg
7021  tcactttttg ttcttcacag atcttttaa tgttctttcc catgttgtat tgcattttg
7081  ggggaagcaa attgactta aagaaaaaag ttgtggcaaa agatgctaag atgcgaaaat
7141  ttcaccacac tgagtcaaaa aggtgaaaaa ttatccattt cctatgcgtt ttactcctca
7201  gagaatgaaa aaaactgcat cccatcaccc aaagttctgt gcaatagaaa tttctacaga
7261  tacaggtata ggggctcaaa gaggtatgtc ggtcagtagt caaaactatg aaatgatact
7321  ggtttctcca caggaatatg gttccattag gctgggagca aaaacaatgt ttttaagat
7381  tgagaataca tacctgacaa cgatccggaa actgctcctc accactcccg tcatgcctgc
7441  tgtcggcgtt tgaccttcca cgtgacagtt cttcacaatt cctttcatca ttttttaaat
7501  attttttta ctgcctatgg gctgtgatgt atatagaagt tgtacattaa acataccctc
7561  atctttttct tttcttttt tttttttct ttagtacaaa gttttagttt cttttcatg
7621  atgtggtaac tacgaagtga tggtagattt aaataattt ttatttttat tttatatatt
7681  ttttcattag ggccatatct ccaaaaaag aaagaaaaa tacaaaaaac aaaaacaaaa
7741  aaaaaagagg gtaatgtaca agtttctgta tgtataaagt catgctcgat ttcaggagag
7801  cagctgatca caatttgctt catgaatcaa ggtgtggaaa tggttatata tggattgatt
7861  tagaaaatgg ttaccagtac agtcaaaaaa gagaaaatga aaaaaataca actaaaagga
7921  agaaacacaa cttcaaagat ttttcagtga tgagaatcca catttgtatt tcaagataat
7981  gtagtttaaa aaaaaaaaaa agaaaaaaac ttgatgtaaa ttcctccttt tcctctggct
8041  taatgaatat catttattca gtataaaatc tttatatgtt ccacatgtta agaataaatg
8101  tacattaaat cttgttaagc actgtgatgg gtgttcttga acactgttct agtttcctta
8161  aagtggtttc ctagtaatca agttatttac aagaaatagg ggaatgcagc agtgtattca
8221  cattataaaa ccctacattt ggaagagacc tttagggtt acctactta gagtggggag
8281  caacagtttg attttctcaa attacttagc taattaactc tcctttgaag caattaactc
8341  taacgacatt gaggtatgat cattttcagt atttatggga ggtggctgct gacccacttg
8401  aggtgagatc tcagaagctt aactggcccg aaaatgtaac attctgcctt ttactaactc
8461  catcttagtt taatcaaagt tcaatctatt ccctgttct tctgtgtgcc tcagagttat
8521  tttgcattta gtttactcca ccgtgtataa tatttatact gtgcaatgtt aaaaaagaat
8581  ctgttatatt gtatgtggtg tacatagtgc aaagtgatga tttctatttc agggcatatt
8641  atggttctca tactccttcc tacctggtgc acagtagctt tttaatacta gtcacttcca
8701  atttaaactt tctcttcctg ggtcattgac tgttactgtg taataatcga tttctttgaa
8761  actgctgcat aattatgctg ttagtggacc tctacctctt ctcttcctc tcccaatcac
8821  agtatactca gaatccccag ccccctcgcat acattgtgtc ggttcacatt actcacagta
8881  atatatggaa gagttagaca agaacatgca gttacagtca ttgtgagacg tgactctcca
8941  gtgtcacgag gaaaaaaatc atcttttctg caaacagtct ctcatctgtc aactcccaca
9001  ttactgagtc aaacagtctt cttacataac aatgcaacca atatatgtt gaattaaaga
9061  cccatttata attctgcttt aaatacatct gcttgctaag aacagatttc agtgctccaa
9121  gcttcaaata tggagatttg taagagggaa ttcaacacta ttctaattc tctcttacag
9181  agtacaaata aaggtgtat acaaactccg aacatatcca gtattccaat cccctttgtca
9241  atcagaagag taaaataatt aacaaaagac tgttgttatg gtttgcattg taaccgatac
9301  gcagagtctg accgttgggc aacaagtttt tctatcctga tgcgcaacac agtctctaga
9361  gactaatcca ggaagacttt agcctccttt ccatattctc acccccgaat caagatttac
9421  agaagcccac gaagaattta cagcccgcct gagatcatct tgcctataaa ctgagttatt
9481  gctttgtcct aaaaattagt cggttttttt ttttctatga ggcttttcag aaatttacag
9541  gatgcccaga ctttacatgt gtaccaaaaa aaaaaaaag ataaaaaata aaggtgcaaa
9601  gaaagttag tattttggaa tggtgctata aagttgaaaa aaaaaaaa
```

SEQ ID NO: 38 Human ARID1B Amino Acid Sequence isoform B (NP_065783.3)

```
  1  mahnagaaaa agthsaksgg seaalkeggs aaalsssssss saaaaaasss sssgpgsame
 61  tgllpnhklk tvgeapaapp hqqhhhhhha hhhhhhahhl hhhhalqqql nqfqqqqqqq
121  qqqqqqqqq qhpisnnnsl ggagggapqp gpdmeqpqhg gakdsaaggq adppgpplls
181  kpgdeddapp kmgepaggry ehpglgalgt qqppvavpgg gggpaavpef nnyygsaapa
241  sggpggragp cfdqhggqqs pgmgmmhsas aaaagapgsm dplqnshegy pnsqcnhypg
301  ysrpgagggg gggggggggs gggggggag aggagagava aaaaaaaaaa ggggggggyg
361  ssagygvlss prqqgggmmm gpgggggasl skaaagsaag gfqrfaggnq hpsgatptln
421  qlltspspmm rsyggsypey sspsappppp sqpqsqaaaa gaaaggqqaa agmglgkdmg
481  aqyaaaspaw aaaqqrshpa msppgtpgprm grsqgspmdp mvmkrpqlyg mgsnphsqpq
541  qsspypggsy gppgpqrypi giqgrcpgam agmqypqqqd sgdatwketf wlmppqygqq
```

TABLE 1-continued

```
 601  gvsgycqggq  qpyysqqpqp  phlppqaqyl  psqsqqryqp  qqdmsqegyg  trsqpplapg
 661  kpnhedlnli  qqerpsslpd  lsgsiddlpt  gteatlssav  sasgstssqg  dqsnpaqspf
 721  sphasphlss  ipggpspspv  gspvgsnqsr  sgpispasip  gsqmppqppg  sqsessshpa
 781  lsqspmpqer  gfmagtqrnp  qmaqygpqqt  gpsmsphpsp  ggqmhagiss  fqqsnssgty
 841  gpqmsqygpq  gnysrppays  gvpsasysgp  gpgmgisann  qmhgqgpsqp  cgavplgrmp
 901  sagmqnrpfp  gnmssmtpss  pgmsqqggpg  mgppmptvnr  kaqeaaaavm  qaaansaqsr
 961  qgsfpgmnqs  glmasssspys qpmnnsssslm ntqappysma  pamvnssaas  vgladmmspg
1021  esklplplka  dgkeegtpqp  eskskkssss  tttgekitkv  yelgneperk  lwvdryltfm
1081  eergspvssl  pavgkkpldl  frlyvcvkei  gglaqvnknk  kwrelatnln  vgtsssaass
1141  lkkqyiqylf  afeckierge  epppevfstg  dtkkqpklqp  pspansgslq  gpqtpqstgs
1201  nsmaevpgdl  kpptpastph  gqmtpmqggr  sstisvhdpf  sdvsdssfpk  rnsmtpnapy
1261  qqgmsmpdvm  grmpyepnkd  pfggmrkvpg  ssepfmtqgq  mpnssmqdmy  nqspsgamsn
1321  lgmgqrqqfp  ygasydrrhe  pygqqypgqg  ppsgqppygg  hqpglypqqp  nykrhmdgmy
1381  gppakrhegd  mynmqyssqq  qemynqyggs  ysgpdrrpiq  gqypypysre  rmqgpgqiqt
1441  hgippqmmgg  plqsssssegp qqnmwaarnd mpypyqnrqg  pggptqappy  pgmnrtddmm
1501  vpdqrinhes  qwpshvsqrq  pymsssasmq  pitrppqpsy  qtppslpnhi  srapspasfq
1561  rslenrmsps  kspflpsmkm  qkvmptvpts  qvtgpppqpp  pirceitfpp  gsveasqpvl
1621  kqrrkitskd  ivtpeawrvm  mslksgllae  stwaldtini  llyddstvat  fnlsqlsgfl
1681  ellveyfrkc  lidifgilme  yevgdpsqka  ldhnaarkdd  sqsladdsgk  eeedaecidd
1741  deedeedeee  dsektesdek  ssialrapta  aadpkekpkq  askfdklpik  ivkknnlfvv
1801  drsdklgrvq  efnsgllhwq  lgggdttehi  qthfeskmei  pprrrppppl  ssagrkkeqe
1861  gkgdseeqqe  ksiiatiddv  lsarpgalpe  danpgpqtes  skfpfgiqqa  kshrniklle
1921  deprsrdetp  lctiahwqds  lakrcicvsn  ivrslsfvpg  ndaemskhpg  lvlilgklil
1981  lhhehperkr  apqtyekeed  edkgvacskd  ewwwdclevl  rdnclvtlan  isgqldlsay
2041  tesiclpild  gllhwmvcps  aeaqdpfptv  gpnsvlspqr  lvletlckls  iqdnnvdlil
2101  atppfsrqek  fyatlvryvg  drknpvcrem  smallcmlaq gdalaaraia  vqkgsignli
2161  sfledgvtma  qyqqsqhnlm  hmqppplepp  svdmmcraak  allamarvde  nrsefllheg
2221  rlldisisav  lnslvasvic  dvlfqigql
```

SEQ ID NO: 39 Human ARID1B cDNA Sequence Variant 3 (NM_001346813.1,
CDS: from 76 to 6945)

```
   1  gggggcggcg  gcgacggcgg  cggcggcctg  aacagtgtgc  accaccaccc  cctgctcccc
  61  cgtcacgaac  tcaacatggc  ccataacgcg  ggcgccgcgg  ccgccgccgg  cacccacagc
 121  gccaagagcg  gcggctccga  ggcggctctc  aaggaggctg  gaagcgccgc  cgcgctgtcc
 181  tcctcctcct  cctcctccgc  ggcggcagcg  gcggcatcct  cttcctcctc  gtcgggcccc
 241  ggctcggcca  tggagacggg  gctgctcccc  aaccacaaac  tgaaaaccgt  tggcgaagcc
 301  cccgccgcgc  cgccccacca  gcagcaccac  caccaccacc  atgcccacca  ccaccaccac
 361  catgcccacc  acctccacca  ccaccacgca  ctacagcagc  agctaaacca  gttccagcag
 421  cagcagcagc  agcagcaaca  gcagcagcag  cagcagcagc  aacagcaaca  tcccatttcc
 481  aacaacaaca  gcttgggcgc  cgcgggcggc  ggcgcgcctc  agcccggccc  cgacatggag
 541  cagccgcaac  atggaggcgc  caaggacagt  gctgcgggcg  gccaggccga  ccccccgggc
 601  ccgccgctgc  tgagcaagcc  gggcgacgag  gacgacgcgc  cgccaagat   ggggagccg
 661  gcgggcggcc  gctacgagca  cccgggcttg  ggcgccctgg  gcacgcagca  gccgccggtc
 721  gccgtgcccg  ggggcggcgg  cggcccggcg  gccgtcccgg  agtttaataa  ttactatggc
 781  agcgctgccc  ctgcgagcgg  cggccccggc  ggccgcgctg  ggccttgctt  tgatcaacat
 841  ggcggacaac  aaagcccggg  gatgggatg   atgcactccg  cctccgccgc  cgccgccggg
 901  gccccggca  gcatggaccc  cctgcagaac  tcccacgaag  ggtaccccaa  cagccagtgc
 961  aaccattatc  cgggctacag  ccggcccggc  gcggcggcgc  gcggcggcgg  cggcggcgga
1021  ggaggaggag  gcagcggagg  aggaggagga  ggaggaggag  caggagcagg  aggagcagga
1081  gcggagctg   tggcggcggc  ggccggcggc  gccggccgcg  cagcaggagg  cggcggcggc
1141  ggcggctatg  ggggctcgtc  cgcggggtac  gggtgctga   gctcccccg   cagcagggc
1201  ggcggcatga  tgatgggccc  cggggggcgg  ggggccgcga  gcctcagcaa  ggcggccgcc
1261  ggctcggcgg  cgggggggctt ccagcgcttc  gccggccaga  accagcaccc  gtcggggcc
1321  accccgacc   tcaatcagct  gctcacctcg  cccagccca   tgatggggaa  ctacggcggc
1381  agctaccccg  agtacagcag  ccccagccg   ccgccgccgc  cgccgtcga   gccccagtcc
1441  caggcggcgg  cgggcggggggcggcggggc  ggccagcagg  cggccgcggg  catgggcttg
1501  ggcaaggaca  tgggcgccca  gtacgccgct  gccagcccgg  cctgggcggc  cgcgcaacaa
1561  aggagtcacc  cggcgatgag  ccccggcacc  cccggaccga  ccatgggcag  atcccagggc
1621  agcccaatgg  atccaatggt  gatgaagaga  cctcagttgt  atggcatggg  cagtaaccat
1681  cattctcagc  ctcagcagag  cagtccgtac  ccaggaggtt  cctatggccc  tcaggcca
1741  cagcggtatc  caattggcat  ccaggtcgg   actcccgggg  ccatgccgg   aatgcagtac
1801  ccccagcagc  agatgccacc  tcagtatgga  cagcaaggtg  tgagtggtta  ctgccagcag
1861  ggccaacagc  catattacag  ccagcagccg  acctcccacc  caggcgcag
1921  tatccgccgt  cccagtccca  gcagaggtac  cagccgcagc  aggacatgtc  tcaggaaggc
1981  tatggaacta  gatctcaacc  tcctctggcc  ccggaaaac   ctaaccatga  agacttgaac
2041  ttaatacagc  aagaaagacc  atcaagttta  ccagatctgt  ctggctccat  tgatgacctc
2101  cccacgggaa  cggaagcaac  tttgagctca  cagtcagtg   catccggtc   cacgagcagc
2161  caaggggatc  agagcaaccc  ggcgcagtcg  cctttctccc  cacatgcgtc  ccctcatctc
2221  tccagcatcc  cggggggccc  atctccctct  cctgttggct  ctcctgtagg  aagcaaccag
2281  tctcgatctg  gcccaatctc  tcctgcaagt  atcccaggta  gtcagatgcc  tccgcagcca
2341  cccggggagc  agtcagaatc  cagttcccat  cccgccttga  gccagtcacc  aatgccacag
2401  gaaagaggtt  ttatggcagg  cacacaaaga  aaccctcaga  tggctcagta  tggacctcaa
2461  cagacaggac  catccatgtc  gcctcatcct  tctcctgggg  gccagatgca  tgctggaacc
2521  agtagctttc  agcagagtaa  ctcaagtggg  acttacggtc  cacagatgag  ccagtatgga
2581  ccacaaggta  actactccag  accccagtcg  tacagtgggg  tgccagtgc   aagctacagc
2641  ggccagggc   ccggtatggg  tatcagtgcc  aacaaccaga  tgcatggaca  agggccaagc
2701  cagccatgtg  gtgctgtgcc  cctgggacga  atgccatcag  ctgggatgca  gaacagacca
2761  tttcctggaa  atatgagcag  catgaccccc  agttctcctg  gcatgtctca  gcagggaggg
2821  ccaggaatgg  ggccgccaat  gccaactgtg  aaccgtaagg  cacaggaggc  agccgcagca
2881  gtgatgcagg  ctgctgcgaa  ctcagcacaa  agcaggcaag  gcagtttccc  cggcatgaac
```

TABLE 1-continued

```
2941 cagagtggac tcatggcttc cagctctccc tacagccagc ccatgaacaa cagctctagc
3001 ctgatgaaca cgcaggcgcc gccctacagc atggcgcccg ccatggtgaa cagctcggca
3061 gcatctgcgg gtcttgcaga tatgatgtct cctggtgaat ccaaactgcc cctgcctctc
3121 aaagcagacg gcaaagaaga aggcactcca cagcccgaga gcaagtcaaa ggatagctac
3181 agctctcagg gtatttctca gccccaacc ccaggcaacc tgccagcccc ttccccaatg
3241 tcccccagct ctgctagcat ctcctcattt catggagatg aaagtgatag cattagcagc
3301 ccaggctggc caaagactcc atcaagccct aagtccagct cctccaccac tactggggag
3361 aagatcacga aggtgtacga gctggggaat gagccagaga gaaagctctg ggtcgaccga
3421 tacctcacct tcacggaaga gagaggctct cccgtctcaa gtctgcctgc cgtgggcaag
3481 aagccctgg acctgttccg actctacgtc tgcgtcaaag atcggggg tttggcccag
3541 gttaataaaa acaagaagtg gcgtgagctg caaccaacc taaacgttgg cacctcaagc
3601 agtgcagcga gccccctgaa aaagcagtat atccagtacc tgtttgcctt tgagtgcaag
3661 atcgaacgtg gggaggagcc cccgccggaa gtcttcagca ccggggacac caaaaagcag
3721 cccaagctcc agccgccatc tcctgctaac tcgggatcct tgcaaggccc acagaccccc
3781 cagtcaactg gcagcaattc catggcagag gtcccaggtg acctgaagcc acctacccca
3841 gcctccaccc ctcacggcca gatgactcca atgcaaggtg gaagaagcag tacaatcagt
3901 gtgcacgacc cattctcaga tgtgagtgat tcatccttcc cgaaacgaaa ctccatgact
3961 ccaaacgccc cctaccagca gggcatgagc atgcccgatg tgatgggcag gatgccctat
4021 gagcccaaca aggacccctt tggggggaatg agaaaagtgc ctggaagcag cgagcccttt
4081 atgacgcaag gacagatgcc caacagcagc atgcaggaca tgtacaacca aagtccccc
4141 ggagcaatgt ctaacctggg catggggcag cgccagcagt ttccctatgg agccagttac
4201 gaccgaaggc atgaaccta tgggcagcag tatccaggcc aaggccctcc ctcgggacag
4261 ccgccgtatg gagggcacca gcccggcctg tacccacagc agccgaatta caaacgccat
4321 atggacggca tgtacgggcc cccagccaag cgccacgagg gcgacatgta caacatgcag
4381 tacagcagcc agcagcagga gatgtacaac cagtatgagg gctcctactc gggcccggac
4441 cgcaggccca tccagggcca gtaccgtat ccctacagca gggagaggat gcaggggcccg
4501 gggcagatcc agacacacga aatcccgcct cagatgatgg cggcccgct gcagtcgtcc
4561 tccagtgagg ggcctcagca gaatatgtgg gcagcacgca atgatatgcc ttatccctac
4621 cagaacaggc agggccctgg cggccctaca caggcgccc cttaccagg catgaaccgc
4681 acagacgata tgatggtacc cgatcagagg acaaatcatg agagccagtg gccttctcac
4741 gtcagccagc gtcagcctta tatgtcgtcc tcagcctcca tgcagcccat cacacgccca
4801 ccacagccgt cctaccgagac gccaccgtca ctgccaaatc acacctccag ggcgcccagc
4861 ccagcgtcct tccagcgctc cctggagaac cgcatgtctc caagcaagtc tccttttctg
4921 ccgtctatga agatgcagga ggtcatgccc acggtcccca catcccagt caccgggcca
4981 ccaccccaac cacccccaat cagaagggag atcacctttc ctcctggctc agtagaagca
5041 tcacaaccag tcctgaaaca aaggcgaaag attacctcca aagataccgt tactcctgag
5101 gcgtggcgtg tgatgatgtc ccttaaatca ggtctttttgg ctgagagtac gtgggctttg
5161 gacactacta atattctccc gcacgatgac agcactgttg ctactttcaa tctctcccag
5221 tcgcctggac ttctcgaacc cttagtcgag tactctagaa aacgcctgac tgacattcct
5281 ggaattctta tggaatatga agtgggagac cccagccaaa aagcacttga tcacaacgca
5341 gcaaggaagg acgacagcca gtcctcggca gacgattctg ggaaagagga ggaagatgct
5401 gaatgtattg atgacgacga ggaagacgag aggaagacag aggaagacga cgagaagaca
5461 gaaagcgatg aaaagagcag catcgctctg actgccccgg acgccgctgc agacccaaag
5521 gagaagccca agcaagccag taagttcgac aagctgccaa taaagacagt caaaaagaac
5581 aacctgtttg tcgttgaccg atctgacaag ttggggcgtg tgcaggagtt caatagtggc
5641 cttctgcact ggcagctcgg cggggtgac accaccgagc acattcagac tcactttgag
5701 agcaagatgg aaatccccc ccgcaggcgc ccacccccc cctcaagctc cgcaggcaga
5761 aagaaagagc aagaaggcaa aggcgactct gaagagcagc aagagaaaag caccatagca
5821 accatcgatg acgtcctctc tgctcggcca ggggcattgc ctgaagacgc aaaccctggg
5881 ccccagaccg aaagcagtaa gtttcccttt ggtatccagc aagccaaaca cccggaac
5941 accaagctgc tggaggacga gcccaggagc cgagacgaga ctcctctgtg taccatcgcg
6001 cactggcagg actcgctggc taagcgatgc atctgtgtgt ccaatattgt ccgtagcttg
6061 tcactcgtgc ccggcaacga cgccgaaacg tccaaacatc caggcccgt gctgatcctg
6121 gggaagctga ttcttcttca ccacgagcat ccagagagaa agcgagcacc gcagacctat
6181 gagaaagagg aggatgagga caaggggtg gcctgcagca aagatgagtg tggtgggac
6241 cgcctcgagg tcttgaggga taacacgttg gtcacgttgg ccaacatttc cggcagcta
6301 gacttgtctg cttacacgga aagcatctgc ttgccaattt tggatggctt gctgcactgg
6361 atggtgtgcc cgtctgcaga ggcacaagat cccttttcaa ctgtgggacc caactcggcc
6421 ctgtcgcctc agagacttgt gctggagacc tctgtgaaac tcagtatcca ggacaataat
6481 gtggacctga tcttggccac tcctcattt agtcgtcagg agaaattcta tgctacatta
6541 gttaggtacg ttggggaccg caaaacccca gtctgccgag aaatgtccat ggcgctttta
6601 tcgaacctcg cccaaggga cgcactagca gcaagggcca tagctgtgca gaaaggaagc
6661 actggaaacc cgacaagctt cctagaggat gggccagca tggcccagca ccgcagagc
6721 cagcacaacc tcatgcacat gcagcccccg cccctggaac cacctagcgt agacatgacg
6781 tgcagggcgg ccaaggcttt gctagccatg gccagagtgg acgaaaaccg ctcggaattc
6841 cctttgcacg agggccggct gctggatacc tcgatatcag ctgcccgaa ctctctggtC
6901 gcatctgtca tctgtgatgc actgtctcag attgggcagt tatgacataa gtgagaaggc
6961 aagcatgtgt gagcgaagac tagagggcca catacaactg gccgttttct gttctcgttt
7021 atccagcgta ggaagaagga aaagaaaacc tttgcCcctc tgccccattc actatttacc
7081 aattgggaat taaagaaata attaatttga acagttatga aattaatatt tgctgtctgt
7141 gtgtacaagt acatcctttg gggttttttct tttccctctt ttttaaccaa agttgctgtc
7201 tag-gcattc aaaggtcacc ttttgttctt cacagatctt tttaatgttc ttccccatgt
7261 cgtattgcat ttttggggga agcaaattga ctttaaagaa aaagttgtg gcaaaagacg
7321 ctaagacgcg aaaatttcac cacactgagt caaaaggtg aaaaactatc cacttcctat
7381 gcgtttcact cctcagagaa tgaaaaaaac tgcatccat cacccaaagt tctgtgcaat
7441 agaaatttct acagatacag gtataggggc tcaaggaggt atgtcggtca gtagtcaaaa
7501 ccatgaaatg acactgctc ctccacagga atatggttcc actcggctgg gagcaaaaac
7561 aatgttttt aagattgaga atacatacct gacaacgatc cggaaactgc tcctcaccac
7621 ccccgtcacg cctgctgtcg gcgtttgacc ttccacgcga cagctcctca caatcccttc
7681 catcatttt taaatatttt ttttactgcc tatgggctgt gatgtatata gaagttgtac
```

TABLE 1-continued

```
7741 attaaacata ccctcatttc tttcttttct ttcttcttcc ttcttttagt acaaagttcc
7801 agtttctttt tcatgatgtg gtaactacga agtgatggta gatttaaata atttttatt
7861 tctactctat atatttttc actagggcca tatctccaaa aaaagaaaga aaaaatacaa
7921 aaaacaaaaa caaaaaaaa agagggtaat gtacaagctt ctgcacgtat aaagccatgc
7981 tcgatttcag gagagcagct gatcacaatt tgcttcatga atcaaggtgt ggaaatggtt
8041 ata~atggat tgatttagaa aatggttacc agtacagtca aaaaagagaa aacgaaaaaa
8101 atacaactaa aaggaagaaa cacaacttca aagatttttc agtgatgaga atccacactt
8161 gtatttcaag ataatgtagt ttaaaaaaaa aaaaagaaa aaaacttgat gtaaattcct
8221 cctcttcctc tggcttaatg aataccattt attcagtata aaatctttat atgttccaca
8281 tgttaagaat aaatgtacat taaatcttgt taagcactgt gatgggtgtt cttgaatact
8341 gttctagttt ccttaaagtg gtttcctagt aatcaagtta tttacaagaa ataggggaat
8401 gcagcagtgt attcacatta taaaaccta catttggaag agacctttag gggttaccta
8461 ctttagagtg gggagcaaca gtttgatttt ctcaaattac ttagctaatt agtcttttctt
8521 tgaagcaatt aactctaacg acattgaggt atgatcattt tcagtattta tgggaggtgg
8581 ctgctgaccc acttgaggtg agatctcaga agcttaactg gcctgaaaat gtaacattct
8641 gccttttact aactccatct tagtttaatc aaagttcaat ctattccttg tttcttctgt
8701 gtgcctcaga gttattttgc atttagttta tcccaccgtg tataatattt atactgtgca
8761 atgttaaaaa agaatctgtc atattgtatg tggtgtacat agtgcaaagt gatgatttct
8821 atttcagggc acattatggt tctcacattc cttcctacct ggtgcacagt agcttttaa
8881 tactagtcac ttctaattta aactttctct tcctgggtca ttgactgtta ctgtgtaata
8941 atcgatttct ttgaacttgc tgcataatta tgtcgttagt ggacctctac ctcttctctt
9001 ccctctccca atcacagtat actcagaatc cccagccct cgcatacatt gtgtcggttc
9061 acattactca cagtaatata tggaagagtt agacaagaac atgcagttac agtcattgtg
9121 agacgtgact ctccagtgtc acgaggaaaa aaatcatctt ttctgcaaac agtctctcat
9181 ctgtcaactc ccacattact gagtcaaaca gtcttcttac ataacaatgc aaccaaatat
9241 atgttgaatt aaagacccat ttataattct gctttaaata catctgcttg ctaagaacag
9301 atttcagtgc tccaagcttc aaatatggag atttgtaaga gggaattcaa tattattcta
9361 atttctctct tacagagtac aaataaaagg tgtatacaaa ctccgaacat atccagtatt
9421 ccaattcctt tgtcaaycag aagagtaaaa taattaacaa aagactgttg ttatggtttg
9481 cattgtaacc gatacgcaga gtctgaccgt tgggcaacaa gttttctat cctgatgcgc
9541 aacacagtct ctagagacta atccaggaag actttagcct ccttttccata ttctcacccc
9601 cgaatcaaga tttacagaag cccacgaaga atttacagcc tgcttgagat catcttgcct
9661 ataaactgag ttattgcttt gtcctaaaaa ttagtcggtt ttttttttc tatgaggctt
9721 ttcagaaatt tacaggatgc ccagacttta catgtgtacc aaaaaaaaaa aaaagataaa
9781 aaataaaggt gcaaagaaag tttagtattt tggaatggtg ctataaagtt gaa
```

SEQ ID NO: 40 Human ARID1B Amino Acid Sequence isoform C
(NP_001333742.1)

```
   1 mahnagaaaa agthsaksgg seaalkeggs aaalsssssss saaaaaasss sssgpgsame
  61 tgllpnhklk tvgeapaapp hqqhhhhhha hhhhhahhl hhhhalqqql nqfqqqqqqq
 121 qqqqqqqqq qhpisnnnsl ggagggapqp gpdmeqpqhg gakdsaaggq adppgpplls
 181 kpgdeddapp kmgepaggry ehpglgalgt qqppvavpgg gggpaavpef nnyygsaapa
 241 sggpggragp cfdqhggqqs pgmgmmhsas aaaagapgsm dplqnshegy pnsqcnhypg
 301 ysrpgagggg ggggggggs gggggggag aggagagava aaaaaaaaaa gggggggygg
 361 ssagygvlss prqqgggmmm gpggggaasl skaaagsaag gfqrfaggnq hpsgatptln
 421 qlltspspmm rsyggsypey ssspsappppp sqpqsqaaaa gaaaggqaa agmglgkdmg
 481 aqyaaaspaw aaaqqrshpa mspgtpgpcm grsqgspmdp mvmkrpqlyg mgsnphsqpq
 541 qsspypggsy gppgpqrypi giqgrtpgam agmqypqqqm ppqygqqgvs gycqqgqqpy
 601 ysqpqpphl ppqaqylpsq sqqryqpqqd msqegygtrs qpplapgkpn hedlnliqqe
 661 rpsslpdlsg siddlptgte atlssavsas gstssqqdqs npaqspfsph asphlssipg
 721 gpspspvgsp vgsnqsrsgp ispasipgsq mppqppgsqs essshpalsq spmpqergfm
 781 agtqrnpqma qygpqqtqps msphpspggq mhagissfqq snssgtygpq msqygpqgny
 841 srppaysgvp sasysgpgpg mgisannqmh gqgpsqpcga vplgrmpsag mqnrpfpgnm
 901 ssmtpsspgm sqqggpgmgp pmptvnrkaq eaaaavmqaa ansaqsrqgs fpgmnqsglm
 961 assspysqpm nnssslnmtq appysmapam vnssaasvgl admmspgesk lplplkadgk
1021 eegtpqpesk skdsyssqgi sqpptpgnlp vpspmspssa sissfhgdes dsisspgwpk
1081 tpsspkssss tttgekitkv yelgneperk lwvdrylyrfm eergspvssl pavgkkpldl
1141 frlyvcvkei gglaqvnknk kwrelatnln vgtsssaass lkkqyiqylf afeckierge
1201 epppevfstg dtkkqpklqp pspansgslq gpqtpqscgs nsmaevpgdl kppptpastph
1261 gqmtpmqggr sstisvhdpl sdvsdssfpk rnsmtpnapy qqgmsmpdvm grmpyepnkd
1321 pfggmrkvpg ssepfmtqgg mpnssmqdmy nqspsgamsn lgmgqrqqfp ygasydrrhe
1381 pygqqypgqs ppsgqppygg hqpglypqqp nykrhmdgmy gppakrhegd mynmqyssqq
1441 qemynqyqqs ysqpdrrpiq qqypypysre rmqqpqqiqt hgippqmmgg plqsssseqp
1501 qqnmwaarnd mpypyqnrqg pggptqappy pgmnrtddmm vpdqrinhes qwpshvsqrq
1561 pymsssasmq pitrppqpsy qtppslpnhi srapspasfq rslenrmsps kspflpsmkm
1621 qkvmptvpts qvtgpppqpp pirreitfpp gsveasqpvl kqrrkitskd ivtpeawrvm
1681 mslksgllae stwaldtini llyddstvat fnlsqlsgfl ellveyfrkc lidifgilme
1741 yevgdpsqka ldhnaarkdd sqsladdsgk eeedaecidd deedeedeee dsektesdek
1801 ssialtapda aadpkekpkq askfdklpik ivkknnlfvv drsdklgrvq efnsgllhwq
1861 lgggdttehi qthfeskmei pprrrppppl ssagrkkeqe gkgdseeqqe ksiiatiddv
1921 lsarpgalpe danpgpqtes skfptgiqqa kshrniklle deprsrdetp lctiahwqds
1981 lakrcicvsn ivrslsfvpg ndaemskhpg lvlilglklil lhhehperkr apqtyekeed
2041 edkgvacskd ewwwdclevl rdntlvtlan isgqldlsay tesiclpild gllhwmvcps
2101 aeaqdpfptv gpnsvlspqr lvletlckls iqdnnvdlil atppfsrqek fyatlvryvg
2161 drknpvcrem smallsnlaq gdalaaraia vqkgsignli stledgvtma qyqqsqhnlm
2221 hmqppplepp svdmmcraak allamarvde nrsefllheg rlldisisav lnslvasvic
2281 dvlfqigql
```

TABLE 1-continued

SEQ ID NO: 41 Mouse ARID1B cDNA Sequence (NM_001085355.1, CDS: from 22 to 6756)

```
   1 tcggcgggcc ccggctcgac catggagacc gggctgctcc ccaaccacaa actgaaagcc
  61 gttggcgagg ccccgctgc accgcccat cagcagcacc accaccaca tgccaccac
 121 caccaccacc accatgccca ccacctccac cacctccacc accaccacgc actacagcag
 181 cagctaaacc agttccagca gccgcagccg ccgcagccac agcagcagca gccgccgcca
 241 ccgccgcagc agcagcatcc cactgccaac aacagcctgg gcggtgcggg cggcggcgcg
 301 cctcagcccg gcccggacat ggagcagccg caacatggag gcgccaagga cagtgtcgcg
 361 ggcaatcagg ctgacccgca gggccagcct ctgctgagca aaccgggcga cgaggacgac
 421 gcgccgccca agatggggga gccggcgggc agccgctatg agcaccgagg cctgggcgcg
 481 cagcagcagc ccgcgccggt cgccgtgccc gggggcggcg cggcccagc ggccgtctcg
 541 gagtttaata attactatgg cagcgctgcc cctgctagcg gcggcccgg cggccgcgct
 601 gggccttgct ttgatcaaca tggcggacaa caaagcccg ggatggggat gatgcactcc
 661 gcctctgccg ccgccgggc cccagcagc atggaccccc tgcagaactc ccacgaaggg
 721 tacccaaca gccagtacaa ccattatccg ggctacagcc ggcccggcgc gggcggcggc
 781 ggcggcgcg gcggaggagg aggaggcagc ggaggaggtg gaggaggag aggagcagga
 841 ggagcaggag gagcagcggc agcggcacga ggagccgcag ctgtggcggc ggcggccgcg
 901 gcggcggcg cagcagcagc agcagcagga ggaggcggtg gcggcggcta tgggagctcg
 961 tcctcggggt acggggtgct gagctcccg cggcagcagg gcggcggcat gatgatgggc
1021 cccggggcg gcggggccgc gagcctcagc aaggcggccg ccggcgcggc ggcggcggcg
1081 ggggcttcc agcgcttcgc cggccagaac cagcaccgt cgggggctac accgaccctc
1141 aaccagctgc tcacctcacc cagccccatg atgaggagct acgcgggtag ctaccccgac
1201 tacagcagct ccagcgcgcc gccgccgccg tgcagcccc agtcccaggc ggcggcgggg
1261 gcggcggcgg gtggccagca ggcggccgcg ggcatgggct gggcaagga cctaggcgcc
1321 cagtacgccg ctgccagcc ggcctgggcg gccgcgcaac aaaggagtca ccggcgatg
1381 agccccggca cccccgacc gaccatgggc agatcccagg gcagccgat ggacccaatg
1441 gtgatgaaga gacctcagtt gtatgggatg gtactcacc cccactccca gccacagcag
1501 agcagcccat acccaggagg ctcctacggt cccccaggtg cacagcggta tcccttggc
1561 atgcagggcc gggctccagg gggcctggga ggcttgcagt acccgcagca gcagatgcca
1621 ccgcagtacg gacagcaagc tgtgagtggc tactgccagc aaggccagca gccatactac
1681 aaccagcagc cgcagccctc gcacctcccg ccccaggcac agtacctgca gccggcggc
1741 gcgcagtccc agcagaggta ccagccacag caggacatgt ctcaagaagg ctatggaact
1801 agatctcagc ctcctctggc ccctggaaaa tccaaccatg aagacttgaa tttaattcaa
1861 caggaaagac catcgagtct accagacctg tctggctcca tcgatgacct ccccacggga
1921 acagaagcaa ctctgagctc agcagtcagt gcatccgggt ctacaagcag ccagggagat
1981 cagagcaacc cagcgcagtc tcctttctcc ccacatgcat cacctcacct ctccagcatc
2041 cctggagggc cgtcaccttc tcctgttggc tctcctgtgg aagcaacca atcgaggtct
2101 ggtccgatct ccctgcgag tattccaggt agccagatgc ctccgcaacc acctggaagc
2161 cagtcagaat ccagttccca tcctgccttg agccagtcac caatgccaca ggaaagaggt
2221 tttatgacag gcactcagag aaaccctcag atgtctcagt acggacctca gcagacagga
2281 ccatccatgt cgcctcaccc accccctggg ggccagatgc atcctgggat cagtaacttt
2341 cagcagagta actcaagtgg cacgtacggc ccacagtga gccagtatgg accccaaggc
2401 aactactcca gaaccccaac atatagcggg gtacccagtg caagctacag cggcccaggg
2461 cccggtatgg gcatcaatgc caacaaccag atgcatggac aagggcagc ccagccatgt
2521 ggtgctatgc ccctgggacg aatgccttca gctgggatgc agaacagacc atttcctgga
2581 accatgagca ggcgtcacccc cagttctcct ggcatgtctc aacagggagg gccaggaatg
2641 ggcccaccaa tgcccactgt gaaccggaag gcccaggaag ctgccgcagc tgtgatgcag
2701 gctgctgcaa actcagcaca aagcaggcaa ggcagttttc ctggcatgaa ccagagtggc
2761 ctggtggcct ccagctctcc ctacagccag tccatgaaca caaactccag cctgatgagc
2821 acccaggccc agccctacag catgacgccc acaatggtga acagtccac agcatcttatg
2881 ggtcttgcag atatgatgtc tcccagtgag tccaaattgt ctgtgcctct taaagcagat
2941 ggtaaagaag aaggcgtgtc ccagcctgag agcaagtcaa aggacagcta tggctctcag
3001 ggcatttccc agcctccaac cccaggcaac ctgcctgtcc cttcccaat gtctcccagc
3061 tctgccagca tctcctcctt tcatggagat gagagtgaca gcattagcag cccagagctgg
3121 cccaagacac catcaagccc taagtccagc tcttcctcca ccactgggga gaagatcacg
3181 aaggtctatg agctggggaa tgagccggag aggaagctgt gggtcgaccg ttacctaacg
3241 ttcatggaag agaggggctc cccggtgtcc agtctgccag cagtgggcaa gaagcccctg
3301 gacctgttcc gactgtatgt ctgcgtcaag gagattggag gttttggcgc aggttaataaa
3361 aacaagaagt ggcgtgagct ggcaaccaac ctgaacgttg gcacttccag cagcgcaggc
3421 agctctctga aaaagcagta tattcagtac ctgttcgcct ttgagtgcaa aactgagcgc
3481 ggggaggagc ccccacctga agtcttcagc accggggatt cgaagaagca gccaaagctc
3541 cagccgccat ctcctgctaa ctcaggatcc ttacaaggcc cacagactcc acagtcaact
3601 gggagcaatt cgatggcaga ggttccaggt gacctgaagc caccaaccc agctctacc
3661 cctcatggac agatgactcc catgcaaagc ggaagaagca gtacagtcag tgtgcatgac
3721 ccgttctcag acgtgagtga ctcagcgtac ccaaaacgga actccatgac tccaaacgcc
3781 ccataccagc agggcatggg catgccagac atgatgggca ggatgcccta tgaacccaac
3841 aaggaccctt tcagtggaat gagaaaagtg cctggaagta gtgagcccctt tatgacacaa
3901 ggacaggtgc ccaacgcgg catgcaggac atgtacaacc agagcccctc aggggccatg
3961 tccaatctgg gcatgggaca cggcagcag ttccctatg aaccagtta tgaccgaagg
4021 catgaggctt acggacagca gtacccaggc caaggcctc ccacaggaca gccaccgtat
4081 ggaggacacc agcctggcct gtacccacag cagccgaatt acaaacgtca tatggatggc
4141 atgtacgggc tccagccaa gcggcacgag ggagacatgt acaacatgca gtatggcagc
4201 cagcagcagg agatgtataa ccagtatgga ggctcctact ctggcccgga cagaaggccc
4261 atccagggac aatatcccta ccccctacaac agagaaagga tgcagggccc aggccagatg
4321 cagccacacg gaatcccacc tcagatgatg ggggccccca tgcagtcatc ctccagcgag
4381 gggcctcagc agaacatgtg ggcgtacacg aacgatatgc cttatcccta ccagagcagg
4441 caaggcccgg gcggccctgc acaggccccc cttacccag catgaaccg cacagatgat
4501 atgatggtac ctgagcagag gatcaatcac gagagccagt ggccttctca cgtcagccag
4561 cgccagcctt acatgtcatc ttcggcctcc atgcagccca tcacgcgccc acctcagtca
4621 tcctaccaga cgccgccgtc actgccaaac cacatctcca gggcaccag ccccgcctcc
```

TABLE 1-continued

```
4681  ttccagcgct  ccctggagag  tcgcatgtct  ccaagcaagt  ctcccttcct  gcccaccatg
4741  aagatgcaga  aggtcatgcc  cacagtcccc  acatcccagg  tcaccgggcc  cccccacag
4801  cctccaccaa  tcagaaggga  gattaccttt  cctcctggct  ccgtagaagc  atcacagcca
4861  atcctgaaac  aaaggcgaaa  gattacctca  aaagatattg  ttactcccga  ggcgtggcgt
4921  gtgatgatgt  cccttaaatc  gggtctgttg  gctgagagca  cgtgggctct  ggacaccacc
4981  aatattctcc  tctatgatga  cagcaccgtc  gccaccttca  atctttccca  gctgtctgga
5041  ttcctggaac  tattagtaga  gtactttcga  aaatgcctaa  ttgacatttt  cggaattctt
5101  atggaatatg  aagtgggtga  ccccagccaa  aaggctcttg  atcaccgttc  agggaagaaa
5161  gatgacagcc  agtccctgga  agatgattct  gggaaggaag  acgatgatgc  tgagtgtctt
5221  gtggaagagg  aggaggagga  agaggaggag  gaggaagaca  gtgaaaagat  agagtcagag
5281  gggaagagca  gccctgccct  agctgctcca  gatgcctccg  tggacccaa   ggagacgcca
5341  aagcaggcca  gtaagtttga  caagctgccc  ataaagattg  tcaaaaagaa  caagctgttt
5401  gtggtggacc  ggtccgacaa  gctgggccga  gtgcaggagt  tcagcagcgg  gctcctccac
5461  tggcagctgg  gtggtggcga  cactaccgag  cacatccaga  ctcacttcga  gagcaagatg
5521  gagatccctc  ctcgcaggcg  tccacctccg  cctctaagct  ccacgggtaa  gaagaaagag
5581  ctggaaggca  aaggtgattc  tgaagagcag  ccagagaaaa  gtatcatagc  caccatcgat
5641  gacgtcttgt  ctgcccggcc  aggggctctg  cctgaagaca  ccaacccagg  acccagacc
5701  gacagcggca  agtttccctt  tggaatccag  caggccaaaa  gccaccggaa  catcaggctc
5761  ctggaagacg  agcccaggag  ccgagacgag  acgccgctgt  gcaccatcgc  gcactggcag
5821  gactcactgg  ccaagcgctg  catctgtgtg  tcgaacatcg  tgcggagctt  gtctttcgtg
5881  cctggcaacg  acgcagagat  gtccaaacac  ccgggcttgg  tgctgatcct  gggaaagctg
5941  attctgctgc  atcacgagca  tccggagaga  aagcgggcgc  cacagaccta  tgagaaggag
6001  gaggacgagg  acaagggggt  ggcctgcagc  aaagatgagt  ggtggtggga  ctgcctcgag
6061  gtcttgcggg  ataacaccct  ggtcacgttg  gcgaacattt  ccgggcagct  agacttgtct
6121  gcttacacag  agagcatctg  cttgccgatc  ctggacggct  tgctacactg  gatggtgtgc
6181  ccgtccgcag  aggctcagga  ccccttccc   actgtggggc  ccaactcagt  cctgtcgccg
6241  cagagacttg  tgctggagac  cctgtgtaaa  ctcagtatcc  aggacaacaa  cgtggacctg
6301  atcttggcca  cgcctccatt  tagtcgtcag  gagaaatttt  atgctacatt  agttaggtac
6361  gttggggatc  gcaaaaatcc  agtcgtcga   gaaatgtcca  tggcgctttt  atcgaacctt
6421  gcccaggggg  acacactggc  ggcgagggca  atagctgtgc  agaaaggaag  cattggtaac
6481  ttgataagct  tcctagagga  cggggtgacg  atggcgcagt  accagcagag  ccagcataac
6541  cttatgcaca  tgcagccccc  acctctggaa  cccctagtg   tagacatgat  gtgccgggcg
6601  gccaaagctc  tgctggccat  ggccagagtg  gacgagaacc  gctcggagtc  cttttgcac
6661  gagggtcggt  tgctggatat  ctcaatatca  gctgtcctga  actctctggt  tgcatctgtc
6721  atctgcgatg  tactgtttca  gattgggcag  ttatgacatc  cgtgaaggca  cacatgtgtg
6781  agtgaacatt  agagggtcac  atataactgg  ctgtttctg   ttctcgttta  tccagtgtaa
6841  gaagaaggaa  aagaaaaatc  tttgctcctc  tgccccgttt  actatttacc  aattgggaat
6901  taaatcatta  atttgaacag  ttataaaatt  aatatttgct  gtctgtgtgt  ataagtacat
6961  cctctggcgg  ttttctgttt  cttttttttt  taaccaaagt  tgccgtctag  tgcattcaaa
7021  ggtcacaatt  tttgtttgtt  tgtttgtttg  tttgttttt   cataattttt  ttcatgttgt
7081  attgcagtct  ttgggaagtg  aattgacttt  ataaagaaaa  acgtttggc   aaaaagtgct
7141  aagatagaaa  aaaatgtcacca cactgggtca  aaacgtgaa   aggaaaaatt  gattcttaaa
7201  ttgattccct  atgaatttta  ttcttcacag  aatgataaaa  gctaaactgc  accccgtcac
7261  ccaaagctct  gtgcaataga  aacttctaga  gatatagtgt  aggggctgaa  ggaggtatgg
7321  cagcagtagt  cagggtcaat  gatactgctt  tctccaccgg  aaagtggtta  cgttaggcct
7381  cgagcaaaaa  acagcgctct  cagataggtg  caaaaatcca  ctcctagcag  ccaacagcag
7441  gatcgcttcc  tcaccacgac  cgccatgtct  gctgtggctc  agcctccacg  ggacaaagct
7501  tcaagatttc  tttcatcatt  tttttaaata  ttttttttac  tgcctatggg  ctgtgatgta
7561  tatagaagtt  gtacattaaa  catacccctca ttttttttctt  cttttcttttt tttctttttt
7621  tcttttttctt tttttttttt  tttagtacaa  agtttttagt  ttctttttca  tgatgtggta
7681  actacgaagt  gatggtagat  ttaaataatt  ttttattttt  atttttatata ttttttcatt
7741  aggaccatat  ctccaaaaaa  caagaaaaag  aaacaaaaaa  tacaaaaaat  aaaaacaaac
7801  aaaaaaagag  ggtaatgtac  aagtttctgt  atgtataaag  tcatgctctg  ttgggagagc
7861  ggctgatccc  agtttgcttc  atgaatcaaa  gtgtggaaat  ggttgcatac  agattgattt
7921  agaaaaatgga  caccagtaca  tacaaaaaaa  gaaaaaagaa  agaaaaccaa  ctaaatggaa
7981  gaaacacaac  ttcaaagatt  tttctgtgac  aagaatccac  atttgtattt  caagataatg
8041  tagtttaaga  aaagaaaaaa  aagaaaaaaa  aagaaaaaaa  cttgatgtaa  attcctcctt
8101  ttcctctggc  ttaatgaata  tcatttattc  agtataaaat  ctttatatgt  cccacatgtt
8161  aagaataaat  gtacattaaa  tcttgttacg  cactgtgatg  ggtgttcttg  aatgctgttc
8221  tagtttgcct  agcatggttg  ccatagtaac  caagttattt  acaggaaata  gggaagatgt
8281  aacaactgct  tcctggtaat  gatgcccaaa  ggccagaagg  gactttcagg  gtttcctact
8341  tgagagtggg  agcaacaatt  tgattttctc  agattgttta  gctaactagg  tcttctttga
8401  agcaattaac  tctggtgaca  ttgagaagtg  gtaattccct  catggatggg  tggtggctgc
8461  caacccactg  tgacatgggg  ccctgcaagc  taactggcct  gaaaccacga  ccttctgcct
8521  ctcactactg  atttaaccca  agtctgcacc  cgtcatgttt  cttctgtgtg  cctccaagtt
8581  actctgcgtt  agtttgctcc  agcgtgtata  atatttatat  tgtgcaatgt  taaagagaac
8641  gtgtcatatt  gtatgccgtg  tgtatagtgc  caagtgatga  ttctgtttca  gagcatacct
8701  tccttcctgc  ccagtccctg  gctctctaat  accccaccct  gatggaaagt  gcttcttcct
8761  gggtaattga  ctgttactgt  gtaacgctca  gtctcattga  aacttacata  accatgctgc
8821  tggtgcccct  tcctacccta  cctctctcag  cactcttcag  ttgacacttc  ccacacctgt
8881  cactgtgtgcc  caccttctc  acgctgacat  ctggaagagt  tagacaggag  cacacactta
8941  caacactagg  agatgttatt  ctggtgtcac  gagaaagaaa  ttggttttttc ctgcaaacag
9001  tcccatcacc  aagcagcccc  cacatcaggt  cagcaaaaag  atctgtgttg  aatcaaaact
9061  ccatttataa  ttctactaga  tgggaataca  tctgcttaca  aaggacagat  tttagtgttc
9121  tgtgatgaaa  atatgggag   tgcaagagag  agttcaatgg  aatcctaatc  ttgctcttgc
9181  agacaatgaa  tgaaaggtat  agacaggctc  agttccctgc  cagaagagtg  gtctcaaaga
9241  caagtggctg  tatagcagcc  aggcccagaa  cagcctcgca  gcacacacta  acaccaagcg
9301  ggtgtctgag  ctctcctagg  aagccttgtg  cctgccctcc  ctccattcac  ccagatccga
9361  ctcctggaag  cccacgaaag  agtcacccctt tgcttcacat  ttcctgacga  taccgagttg
9421  ctgctctgtc  ctaaaaatat  tagttctttt  ccagggcttt  cagaaatttg  caggatgccc
```

TABLE 1-continued

```
 9481 atactctaaa tgtgtaccaa aaagagagag aaataaaggt gcgaagaaag tttagtattt
 9541 tggaatggtg cgataaaatg gaatctgttg gttttttaatg taacataaga tactattggc
 9601 tggcactggc taaaaaaaat atctaagtgt tggagttgga tgcacaatca acttttactt
 9661 agctattcaa agagtactta tgtttttccaa gttaaaacag acttgttttt gacaggggcc
 9721 gtgggtggtc ttatacaatg ccagctccta actgcagcagt ctgagaactg gatatcgttt
 9781 gccctgagag ctgcccgtct ccaactatgt gctgctgctg ccctgtgtgc tcagcccaca
 9841 aggatgtgga gactggatag acaaccccctt gcttcttgct gggttgtgct gagttctttg
 9901 cagtccagtc aagtgcccag agctaccagc ctacgtccct catgcatcca agagaaatga
 9961 tcttgactat catgatcaaa acagctgtag taatatttct agtaaatatt tctgatgact
10021 ctgtgtaatc tcctacaaca ggacactatt cattaacttg acagagacat gtgggcatgt
10081 ggtcctgctt tagtttaaca gacaagtcaa ccagttctca ttacttagga agagtgaggc
10141 tatgtctgtt acaatcccaa tgtggtgctt gcccttatcc aaagacagtc cggggggcct
10201 gtctgcctga actatgtctc gctccctctt gggcttccca ctgggatgtg aaaagataac
10261 caatggctcc caggttccca gtgccccca aaccagtaat caggtctggg actacagaac
10321 ccgcaaaatc atacacaggc tgtttcaaag ccagtactct ctttatactc ctgcttcctc
10381 cagcccccat ttcacacccc acccaaatca caaggtcctc tgaagtctca gaactccaaa
10441 ttaacgttgg gatttacgat gtgaatgctg aggagaaaat tgggagttgg tgggagatca
10501 ccaaattgtc aaaactatga aactcatctg tcttcccaaa tctgacctca gggacttggg
10561 gggttcactc tggcttctgc cacagtattt tctgggggaac caaaggcctc gggaatagag
10621 aaacaggttg ccggatatcc tggaagtcta agccatactg accagtttgt cttgagtgtt
10681 ttctttgtga gcctggaact gtccccggac cccttttctt taaacatggt tcaggactt
10741 aaaaaaaagc actgtatttt ttttatgtaa gccaagatgc cctccctagc agagatagcc
10801 ttgaactgtc tctagttctg tagcctgaga gacttaaatc gttaacttc agtgtcttg
10861 tccactctgt tgaactgcta aggattctat tgaatgtgtt ctttgcggct ttggaggagt
10921 tgctgggtgt gtaagtcctg catcccttg cctggtatgt gtatattatt cctttgcctg
10981 gctgtgtatc gttcttcagt gtaagtacac ccacactctg tattcctttg cctgctcccc
11041 gcccccccac acacacacat cctgcatagt tttaaaataa ggcctgagag actgtttcta
11101 tttcctgtca tagctggtga cttttaacag ttgaggcgaa tggcctgtca cttgcctggg
11161 ttcccgtcag gggtgatcca tggaactcct cagtggaaca gaatttagga cagaagatcc
11221 caccttcctt ccaggcctgg ggagaatcag actgtgagat aaaccatgat gctgcccaat
11281 cccactgccc caccttgctt ttaaaataaa gtgcctccta acgtc
```

SEQ ID NO: 42 Mouse ARID1B Amino Acid Sequence (NP_001078824.1)
```
    1 metgllpnhk lkavgeapaa pphqqhhhhh ahhhhhhhah hlhhhlhhha lqqqlnqfqq
   61 pqppqpqqqq pppppqqqhp tannslggag ggapqpgpdm eqpqhggakd svagnqadpq
  121 gqpllskpgd eddappkmge pagstyehpg lgaqqqpapv avpgggggpa avsefnnyyg
  181 saapasggpg gragpcfdqh gqqspgmgm mhsasaaaga pssmdplqns hegypnsqyn
  241 hypgysrpga gggggggg ggsggggggg gaggaggaaa aaagagavaa aaaaaaaaa
  301 aagggggggy gssssgygvl ssprqgggm mmgpggggaa slskaaagaa aaaggfqrfa
  361 gqnqhpsgat ptlnqlltsp spmmrsyggs ypdyssssap pppsqpqsqa aagaaaggqq
  421 aaagmglgkd lgaqyaaasp awaaaqqrsh pamspgtpgp tmgrsqgspm dpvmkrpql
  481 ygmgthphsq pqqsspypgg sygppgaqry plgmqgrapg algglqypqq qmppqygqqa
  541 vsgycqqgqq pyynqqpqps hlppqaqylq paaaqsqqry qpqqdmsqeg ygtrsqppla
  601 pgksnhedln liqqerpssl pdlsgsiddl ptgteatlss avsasgstss qgdqsnpaqs
  661 pfsphasphl ssipggpsps pvgspvgsnq srsgpispas ipgsqmppqp pgsqsessssh
  721 palsqspmpq ergfmtgtqr npqmsqygpq qtgpsmsphp spgqqmhpgi snfqqsnssg
  781 tygpqmsqyg pqgnysrtpt ysgvpsasys gpgpgmgina nnqmhgqgpa qpcgamplgr
  841 mpsagmqnrp fpgtmssvtp sspgmsqqgg pgmgppmptv nrkaqeaaaa vmqaaansaq
  901 srqgsfpgmn qsglvassp ysqsmnnnss lmstqaqpys mtptmvnsst asmgladmms
  961 pseskslsvpl kadgkeegvs qpeskskdsy gsqgisqpt pgnlpvpspm spssasissf
 1021 hgdesdsiss pgwpktpssp ksssssttge kitkvyelgn eperklwvdr yltfmeergs
 1081 pvsslpavgk kpldlfrlyv cvkeigglaq vnknkkwrel acnlnvgtss saasslkkqy
 1141 iqylfafeck tergeeppe vfstgdskkq pklqppspan sgslqgpqtp qstgsnsmae
 1201 vpgdlkpptp astphgqmtp mqsgrsstvs vhdpfsdvsd saypkrnsmt pnapyqqgmg
 1261 mpdmmgrmpy epnkdpfsgm rkvpgsspef mtqggvpnsg mqdmynqsps gamsnlgmgq
 1321 rqqfpygtsy drrheaygqq ypgqppptgq ppygghqpgl ypqqpnykrh mdgmygppak
 1381 rhegdmynmq ygsqqqemyn qyggsysgpd rrpiqqqypy pynrermqgp gqmqphgipp
 1441 qmmggpmqss sseqpqqnmw atrndmpypy qsrqgpggpa qappypgmnr tddmnvpeqr
 1501 inhesqwpsh vsqrqpymss sasmqpitrp pqssyqtpps lpnhisraps pasfqrsles
 1561 rmspskspfl ptmkmqkvmp tvptsqvtgp ppqpppirre itfppgsvea sqpilkqrrk
 1621 itskdivtpe awrvmmslks gllaestwal dtinillydd stvatfnlsq lsgflellve
 1681 yfrkclidif gilmeyevgd psqkaldhrs gkkddsqsle ddsgkeddda eclveeeeee
 1741 eeeeedseki esegksspal aapdasvdpk etpkqaskfd klpikivkkn klfvvdrsdk
 1801 lgrvqefssg llhwqlgggd ttehiqthfe skmeipprrr ppplsstgk kkelegkgds
 1861 eeqpeksiia tiddvlsarp galpedtnpg pqcdsgkfpf giqqakshrn irlledeprs
 1921 rdetplctia hwqdslakrc icvsnivrsl sfvpgndaem skhpglvlil gklillhheh
 1981 perkrapqty ekeededkgv acskdewwwd clevlrdntl vtlanisgql dlsaytesic
 2041 lpildgllhw mvcpsaeaqd pfptvgpnsv lspqrlvlet lcklsiqdnn vdlilatppf
 2101 srqektyatl vryvgdrknp vcremsmall snlaqgdtla araiavqkgs ignlisfled
 2161 gvtmaqyqqs qhnlmhmqpp pleppsvdmm craakallam arvdencsef llhegrllldi
 2221 sisavlnslv asvicdvlfq igql
```

SEQ ID NO: 43 Human CRB1 cDNA Sequence Variant 1 (NM_201253.2. CDS: from 210 to 4430)
```
    1 cctcccgtgt aagtgatgct aagaagcaca aactgcactt tgaatctaag ccctgtatt
   61 ttccgtgaag gagctgcaag taggggtggga cagagatggc acctgggggc tctgaggcac
  121 ccgctcctct ctgagacaga cagggatcag gagccggact gggaccagac caccagcaac
  181 acaccagagg atgttctcta aataagacca tggcacttaa gaacattaac taccttctca
  241 tcttctacct cagtttctca ctgcttatct acataaaaaa ttcctttgc aataaaaaca
  301 acaccaggtg cctctcaaat tcttgccaaa acaattctac atgcaaagat ttttcaaaag
```

TABLE 1-continued

```
 361 acaatgattg ttcttgttca gacacagcca ataatttgga caaagactgt gacaacatga
 421 aagacccttg cttccccaat ccctgtcaag gaagtgccac ttgtgtgaac accccaggag
 481 aaaggagctt tctgtgcaaa tgtcctcctg ggtacagtgg gacaatctgt gaaactacca
 541 ttggttcctg tggcaagaac tcctgccaac atggaggtat ttgccatcag gaccctattt
 601 atcctgtctg catctgccct gctgatatg ctggaagatt ctgtgagata gatcacgatg
 661 agtgtgcttc cagcccttgc caaaatgggg ccgtgtgcca ggatggaatt gatggttact
 721 cctgcctctg tgtcccagga tatcaaggca gacactgcga cttggaagtg gatgaatgtg
 781 cttcagatcc ctgcaagaac gaggctacat gcctcaatga aataggaaga tatacttgta
 841 tctgtcccca caattattct ggtgtaaact gtgaattgga aattgacgaa tgttggtccc
 901 agccttgttt aaatggtgca acttgtcagg atgctctggg ggcctatttc tgcgactgtg
 961 cccctggatt cctgggggat cactgtgaac tcaacactga tgagtgtgcc agtcaacctt
1021 gtctccatgg agggctgtgt gtggatggag aaaacagata tagctgtaac tgcacgggta
1081 gtggattcac agggacacac tgtgagacct tgatgcccct ttgttggtca aaaccttgtc
1141 acaataatgc tacatgtgag gacagtgttg acaattacac ttgtcactgc tggcctggat
1201 acacaggtgc ccagtgtgag atcgacctca atgaatgcaa tagtaacccc tgccagtcca
1261 atggggaatg tgtggagctg tcctcagaga aacaaatatg acgcatcact ggactgcctt
1321 cttctttcag ctaccatgaa gcctcaggtt atgtctgtat ctgtcagcct ggattcacag
1381 gaatccactg cgaagaagac gtcaatgaat gttcttcaaa cccttgccaa aatggtggta
1441 cttgtgagaa cttgcctggg aattatactt gccattgccc atttgataac cttctagaa
1501 ctttttatgg aggaagggac tgttctgata ttctcctggg ctgtacccat cagcaatgtc
1561 taaataatgg aacatgcatc cctcacttcc aagatgccca gcatggattc agctgcctgt
1621 gtccatctgg ctacaccggg tccctgtgtg aaatcgcaac cacactttca tttgagggcg
1681 atggcttcct gtgggtcaaa agtggctcag tgacaaccaa gggctcagtt tgtaacatag
1741 ccctcaggtt tcagactgtt cagccaatgg ctcttctact tttccgaagc aacagggatg
1801 tgtttgtgaa gctggagctg ctaagtggct acattcactt atcaattcag gtcaataatc
1861 agtcaaaggt gcttctgttc atttcccaca acaccagcga tggagagtgg catttcgtgg
1921 aggtaatatt tgcagaggct gtgaccctta ccttaatcga cgactcctgt aaggagaaat
1981 gcatcgcgaa agctcctact ccacttgaaa gtgatcaatc aatatgtgct tttcagaact
2041 ccttttttgg tggtttacca gtgggaatga ccagcaatgg tgttgctctg cttaacttct
2101 ataatatgcc atccacacct tcgtttgtag gctgtctcca agacattaaa attgattgga
2161 atcacattac cctggagaac atctcgtctg gctcatcatt aaatgtcaag gcaggctgtg
2221 tgagaaagga ttggtgtgaa agccaaccct gtcaaagcag gacgctgc atcaacttgt
2281 ggccgagtta ccagtgtgac tgccacaggc cctatgaagg ccccaactgt ctgagagagt
2341 atgtggcagg cagatttggc caggatgact ccactggttca tgtcatcttt actcttgatg
2401 agagctatgg agacaccatc agcctctcca tgtttgtccg aacgcttcaa ccatcaggct
2461 tacttctagc tttggaaaac agcacttatc aatatatccg tgtctggcta gagcgcggca
2521 gactagcaat gctgactcca aactcccca aattagtagt aaaatttgtt cttaatgatg
2581 gaaatgtcca cttgatatct ttgaaaatca agccatataa aattgacta tatcagtctt
2641 cacaaaacct aggatttatt tctgcttcta cgtggaaaat cgaaagggga gatgtcatct
2701 acattggtgg cctacctgac aagcaagaga ctgaacttaa tggtggattc ttcaaaggct
2761 gtatccaaga tgtaagacta acaaccaaa atctggaatt ctttccaaat ccaacaaaca
2821 atgcatctct caatccagtt cttgtcaatg taccccaagc ctgtgctgga gacaacagct
2881 gcaagtccaa cccctgtcac aatggaggtg tttgccattc ccggtgggat gacttctcct
2941 gttcctgtcc tgccctcaca agtgggaaag cctgtgagga ggttcagtgg tgtggattca
3001 gcccgtgtcc tcacggagcc cagtgccagc cggtgcttca aggatttgaa tgtattgcaa
3061 atgctgtttt taatgacaa agcggtcaaa tattattcag aagcaatggg aatattacca
3121 gagaactcac caatatcaca tttggtttca gaacaaggga tgcaaatgta ataatattgc
3181 atgcagaaaa agagcctgaa tttcttaaca ttagcattca agattccaga ttattctttc
3241 aattgcaaag tggcaacagc ttttatatgc taagtctgac aagtttgcag tcagtgaatg
3301 atggcacatg gcacgaagtg acccttttcca tgacagccc actgtcccag acctccaggt
3361 ggcaaatgga agtggacaac gaaacacctt ttgtgaccag cacaattgct actggaagcc
3421 tcaacttttt gaaggataat acagatattt atgtgggaga cagagctatt gacaatataa
3481 agggcctgca agggtgtcta agtacaatag aaatcggagg catttatctc tcttactttg
3541 aaaatgttca tggtttcatt aataaacctc aggaagagca atttctcaaa atctctacca
3601 attcagtggt cactggctgt ttgcagttaa atgtctgcaa ctccaacccc tgtttgcatg
3661 gaggaaactg tgaagacatc tatagctctt atcattgctc ctgtccttg ggatggtcag
3721 ggaaacactg tgaactcaac atcgatgaat gcttttcaaa cccctgtatc catggcaact
3781 gctctgacag agttgcagcc taccactgca catgtgagcc tggatacact ggtgtgaact
3841 gtgaagtgga tatagacaac tgccagagtc accagtgtgc aaatggagcc acctgcatta
3901 gtcatactaa tggctattct tgcctctgtt ttggaaattt tacaggaaaa ttttgcagac
3961 agagcagatt accctcaaca gtctgtggga atgagaagac aaatctcact tgctacaatg
4021 gaggcaactg cacagagttc cagactgaat taaatgtat gtgccggcca ggttttactg
4081 gagaatggtg tgaaaaggac attgatgagt gtgcctctga tccgtgtgct aggaggtc
4141 tgtgccagga cttactcaac aaaattccagt gcctctgtga tgttgccttt gctggcgagc
4201 gctgcgaggt ggacttggca gatgacttga tctccgacat tttcaccact attggctcag
4261 tgactgtcgc cttgttactg atcctcttgc tggccattgt tgcttctgtt gtcacctcca
4321 acaaagggc aactcaggga acctacagcc ccagccgtca ggagaaggag ggctcccgag
4381 tggaaatgtg gaacttgatg cacccccctg caatggagag actgatttag gagcattgtg
4441 tcccttcgag atgggggatcc acacactgta aatgtgatga ctgtacttca ggtatctctg
4501 acatacctga caatgttaat ctgcaactgg gattacactg gaactacagg aatgattcct
4561 ttgaccacct taaaaacttt cacagtggtt ccgctcgaca ccactgtttt attatattat
4621 atcagccaat tgcaaaaaa gtcgtgcca gtaatttcag ccttataatt agcaaaaaca
4681 tcttcagag aataaagtct tctgtggctt tagtggccat cactgaaact cttcctctt
4741 ttcaacctgg gaacaaattt tagttttcat ttaggtttc tgtactttct gtagtttctg
4801 tgtaaactgc catatgtttta catggaaact acaggaaaaa attggctaca tttctcactt
4861 ctcctatcat gtggtcaaag ttattgttgt ataccagcga tgggatgtat acttttgtcc
4921 ttcattcatg gattcagaga aagctctggg aacgacttat ggtccaaaaa agtgacccaa
4981 tggcaacaaa taaaaattga aatgcaaaaa aaaaaaaaaa aaaa
```

TABLE 1-continued

SEQ ID NO: 44 Human CRB1 Amino Acid Sequence Isoform A (NP_957705.1)

```
   1  malkninyll ifylsfslli yiknsfcnkn ntrclsnscq nnstckdfsk dndcscsdta
  61  nnldkdcdnm kdpcfsnpcq gsatcvntpg ersflckcpp gysgticett igscgknscq
 121  hggichqdpi ypvcicpagy agrfceidhd ecasspcqng avcqdgidgy scfcvpgyqg
 181  rhcdlevdec asdpckneat clneigrytc icphnysgvn celeidecws qpclngatcq
 241  dalgayfcdc apgflgdhce lntdecasqp clhgglcvdg enryscnctg sgftgthcet
 301  lmplcwskpc hnnatcedsv dnytchcwpg ytgaqceidl necnsnpcqs ngecvelsse
 361  kqygritglp ssfsyheasg yvcicqpgft gihceedvne cssnpcqngg tcenlpgnyt
 421  chcpfdnlsr tfyggrdcsd illgcthqqc lnngtciphf qdgqhgfscl cpsgytgslc
 481  eiattlsteg dgflwvksgs vttkgsvcni alrfqtvqpm alllfrsntd vfvklellsg
 541  yihlsiqvnn qskvllfish ntsdgewhfv evifaeavtl tliddsckek ciakapptle
 601  sdqsicafqn sflgglpvgm tsngvallnf ynmpstpsfv gclqdikidw nhitleniss
 661  gsslnvkagc vrkdwcesqp cqsrgrcinl wlsyqcdchr pyegpnclre yvagrfgqdd
 721  stgyviftld esygdtisls mfvrtlqpsg lllalensty qyirvwlerg rlamltpnsp
 781  klvvkfvlnd gnvhlislki kpykielyqs sqnlgfisas twkiekgdvi yigglpdkqe
 841  telnggffkg ciqdvrlnnq nleffnpnptn naslnpvlvn vtqgcagdns cksnpchngg
 901  vchsrwddfs cscpaltsgk aceevqwcgf spcphgaqcq pvlqgfecia navfngqsgq
 961  ilfrsngnit reltnitfgf rtrdanviil haekepefln isiqdsrlff qlqsgnstym
1021  lsltslqsvn dgtwhevtls mtdplsqtsr wqmevdnetp fvtstiatgs lnflkdntdi
1081  yvgdraidni kglqgclsti eiggiylsyf envhgfinkp qeeqflkist nsvvtgclql
1141  nvcnsnpclh ggncediyss yhcscplgws gkhcelnide cfsnpcihgn csdrvaayhc
1201  tcepgytgvn cevdidncqs hqcangatci shtngysclc fgnftgkfcr qsrlpstvcg
1261  nektnltcyn ggnctefqte lkcmcrpgft gewcekdide casdpcvngg lcqdllnkfq
1321  clcdvafage rcevdladdl isdifttigs vtvallllil laivasvvts nkratqgtys
1381  psrqekegsr vemwnlmppp amerli
```

SEQ ID NO: 45 Human CRB1 cDNA Sequence Variant 2 (NM_001193640.1, CDS; from 210 to 4094)

```
   1  cctcccgtgt aagtgatgct aagaagcaca aactgcattt tgaatctaag tccctgtatt
  61  ttctgtgaag gagctgtaag tagggtggga cagagatggc acctgggggt tctgaggcac
 121  ccgctcctct ctgagacaga cagggatcag gagccggact gggaccagac caccagcaac
 181  acaccagagg atgttctcta aataagacca tggcacttaa gaacattaac taccttctca
 241  tcttctacct cagtttctca ctgcttatct acataaaaaa ttccttttgc aataaaaaca
 301  acaccaggtg cctctcaaat tcttgccaaa acaattctac atgcaaagat ttttcaaaag
 361  acaatgaggt gttccttgtt gacacagcca ataatttgga caaagactgt gacaacatga
 421  aagaccctty cttctccaat ccctgtcaag gaagtgccac ttgtgtgaac accccaggag
 481  aaaggagctt tctgtgcaaa tgtcctcctg ggtacagtgg acaatctgt gaaactacca
 541  ttggttcctg tggcaagaac tcctgccaac atggaggtat ttgccatcag gaccctattt
 601  atcctgtctg catctgccct gctggatatg ctggaagatt ctgtgagata gatcacgatg
 661  agtgtgcttc cagcccttgc caaaatgggg ccgtgtgcca ggatggaatt gatggttact
 721  cctgcttctg tgtcccagga tatcaaggca gacactgcga cttggaagtg gatgaatgtg
 781  cttcagatcc ctgcaagaac gaggctacat gcctcaatga aataggaaga tatacttgta
 841  tctgtcccca caattattct ggatacacag gtgcccagtg tgagatcgac ctcaatgaat
 901  gcaatagtaa ccctgccag tccaatgggg aatgtgtgga gctgtcctca gagaaacaat
 961  atggacgcat cactggactg ccttcttctt tcagctacca tgaagcctca ggttatgtct
1021  gtatctgtca gcctggattc acaggaatcc actgcgaaga agacgtcaat gaatgttctt
1081  caaacccttg ccaaaatggt ggtacttgtg agaacttgcc tgggaattat acttgccatt
1141  gcccatttga taaccttcct agaacttttt atggaggaag ggactgttct gatattctcc
1201  tgggctgtac ccatcagcaa tgtctaaaca atggaacatg catccctcac ttccaagatg
1261  gccagcatgg attcagctgc ctgtgtccat ctggctacca cgggtccctg tgtgaaatcg
1321  caaccacact tcatttgag ggcgatggct tcctgtgggt caaaagtggc tcagtgacaa
1381  ccaagggctc agtttgtaac atagccctca ggtttcagac tgttcagcca atggctcttc
1441  tacttttccg aagcaacagg gatgtgtttg tgaagctgga gctgctaagt ggctacattc
1501  acttatcaat tcaggtcaat aatcagtcaa aggtgcttct gttcatttcc cacaacacca
1561  gcgatggaga gtggcatttc gtggaggtaa tatttgcaga ggctgtgacc cttaccttaa
1621  tcgacgactc ctgtaaggag aaatgcatcg cgaaagctcc tactccactt gaaagtgatc
1681  aatcaatatg tgcttttcag aactccttt tgggtggttt accagtggga atgaccagca
1741  atggtgttgc tctgcttaac ttccataata tgccatccac accttcgtt gtaggctgtc
1801  tccaagacat taaaattgat tggaatcaca ttaccctgga gaacatctcg tctggctcat
1861  cattaaatgt caaggcaggc tgtgtgagaa aggattggtg tgaaagccaa ccttgtcaaa
1921  gcagaggacg ctgcatcaac ttgtgctga gttaccagtg tgactgccac aggccctatg
1981  aaggccccaa ctgtctgaga gagtatgtgg caggcagatt tggccaggat gactccactg
2041  gttatgtcat ctttactctt gatgagagct attggagacac catcagcctc tccatgtttg
2101  tccgaacgct tcaaccatca ggcttacttc tagctttgga aaacagcact tatcaatata
2161  tccgtgtctg gctagagcgc ggcagactag caatgctgac tccaaactct cccaaattag
2221  tagtaaaatt tgttcttaat gatggaaatg tccacttgat atctttgaaa atcaagccat
2281  ataaaattga actgtatcag tcttcacaaa acctaggatt tatttctgct tctacgtgga
2341  aaatcgaaaa gggagatgtc atctcacttg gtggcctacc tgacaagcaa gagactgaac
2401  ttaatggtgg attcttcaaa ggctgtatcc aagatgtaag actaaacaac caaaatctgg
2461  aattcttttcc aaatccaaca aacaatgcat ctctcaatcc agttcttgtc aatgtaaccc
2521  aaggctgtgc tggagacaac agctgcaagt ccaacccctg tcacaatgga ggtgtttgcc
2581  attcccggtg ggatgacttc tcctgttcct gcctgccct cacaagtggg aaagcctgtg
2641  aggaggttca gtggtgtgga ttcagcccgt gtcctcacg agcccagtgc cagccggtgc
2701  tccaaggatt tgaatgtatt gcaatgctgt tttttaatgg acaaagcggt caaatattat
2761  tcaagaagca tggsgaatatt accagagaac tccaatat cacatttggt ttcagaacaa
2821  gggatgcaaa tgtaataata ttgcatgcag aaaaagagcc tgaatttctt aatattagca
2881  ttcaagattc cagattattc tttcaattgc aaagtggcaa cagcttttat atgctaagcc
2941  tgacaagttt gcagtcagtg aatgatggca catggcacga agtgaccctt tccatgacag
3001  acccactgtc ccagacctca aggtggcaaa tggaagtgga caacgaaaca ccttttgtga
3061  ccagcacaat tgctactgga agcctcaact ttttgaagga taatacagat atttatgtgg
```

TABLE 1-continued

```
3121 gagacagagc tattgacaat ataaagggcc tgcaagggtg tctaagtaca atagaaatcg
3181 gaggcattta tctctcttac tttgaaaatg ttcatggttt cattaataaa cctcaggaag
3241 agcaatttct caaaatctct accaattcag tggtcactgg ctgtttgcag ttaaatgtct
3301 gcaactccaa ccctgtttg catggaggaa accgtgaaga catctatagc tcttatcatt
3361 gctcccgtcc cttgggatgg tcagggaaac actgtgaact caacatcgat gaatgctttt
3421 caaaccctg tatccatggc aactgctctg cagagttgc agcctaccac tgcacatgtg
3481 agcctggata cactggtgtg aactgtgaag tggatataga caactgccag agtcaccagt
3541 gtgcaaatgg agccacctgc attagtcata ctaatggcta ttcttgcctc tgttttggaa
3601 attttacagg aaaattttgc agacagagca gattaccctc aacagtctgt gggaatgaga
3661 agacaaatct cacttgctac aatggaggca actgcacaga gttccagact gaattaaaat
3721 gtatgtgccg gccaggtttt actggagaat ggtgtgaaaa ggacattgat gagtgtgcct
3781 ctgatccgtg tgtcaatgga ggtctgtgcc aggacttact caacaaattc cagtgcctct
3841 gtgatgttgc ctttgctggc gagcgctgcg aggtagatgc tggcagatgac ttgatctccg
3901 acattttcac cactattggc tcagtgactg tcgccttgtt actgatcctc ttgccggcca
3961 tcgttgcttc tgttgtcacc tccaacaaaa gggcaactca gggaacctac agcccagcc
4021 gtcaggagaa ggagggctcc cgagtggaaa tgtggaactt gatgccaccc cctgcaatgg
4081 agagactgat ttaggagcat tgtgtcccct cgagatgggg atccacacac tgtgaatgtg
4141 atgactgtac ttcaggtatc tctgacatac ctgacaatgt taatctgcaa ctgggattac
4201 actggaacta caggaatgat tcctttgacc accttaaaaa cttcacagt ggttccgctc
4261 gacaccattg tttattata ttataccagc caattgcaaa aaaagtctgt gccagtaatt
4321 tcagccttat aattagcaaa aacatcttcc agagaataaa gtcttctgtg gcttagtgg
4381 ctatcactga aactcttcc tcttttcaac ctgggaacaa attttagttt tcatttagg
4441 ttcctgtact ttctgtagtt tctgtgtaaa ctgccatatg tttacatgga aactacagga
4501 aaaaattggc tacatttctc acttctccta tcatgtggtc aaagttattg ttgtatacca
4561 gcgatgggat gtatacttt gtccttcatt catggattca gagaaagctc tgggaatgac
4621 ttatggtcca aaaagtgac ccaatggcaa caaataaaaa ttgaaatgca aaaaaaaaaa
4681 aaaaaaaa
```

SEQ ID NO: 46 Human CRB1 Amino Acid Sequence Isoform B (NP_0011X0569.1)
```
    1 malkninyll ifylsfslli yiknsfcnkn ntrclsnscq nnstckdfsk dndcscsdta
   61 nnldkdcdnm kdpcfsnpcq gsatcvntpg ersflckcpp gysgticett igscgknscq
  121 hggichqdpi ypvcicpagy agrfceidhd ecasspcqng avcqdgidgy scfcvpgyqg
  181 rhcdlevdec asdpckneat clneigrytc icphnysgyt gaqceidlne cnsnpcqsng
  241 ecvelssekq ygritglpss fsyheasgyv cicqpgftgi hceedvnecs nnpcqnggtc
  301 enlpgnytch cpfdnlsrtf yggrdcsdil lgcthqqcln ngtciphfqd gqhgfsclcp
  361 sgytgslcei attlsfegdg flwvksgsvt tkgsvcnial rfqtvqpmal llfrsnrdvf
  421 vklellsgyi hlsiqvnnqs kvllfishnt sdgewhfvev ifaeavtltl iddsckekci
  481 akaptplesd qsicafqnsf lgglpvgmts ngvallnfyn mpstpsfvgc lqdikidwnh
  541 itlenissgs slnvkagcvr kdwcesqpcq srgrcinlwl syqcdchrpy egpnclreyv
  601 agrfgqddst gyviftldes ygdtislsmf vrtlqpsgll lalenstyqy irvwlergrl
  661 amltpnspkl vvkfvlndgn vhlislkikp ykielyqssq nlgfisastw kiekgdviyi
  721 gglpdkqete lnggffkgci qdvrlnnqnl effpnptnna slnpvlvnvt qgcagdnsck
  781 snpchnggvc hsrwddfscs cpaltsgkac eevqwcgfsp cphgaqcqpv lqgfeciana
  841 vfngqsgqil frsngnitre ltnitfgfrt rdanviilha ekepeflnis iqdsrlffql
  901 qsgnsfymls ltslqsvndg twhevtlsmt dplsqtsrwq mevdnetpfv tstiatgsln
  961 flkdntdiyv gdraidnikg lqgclstiei ggiylsyfen vhgfinkpqe eqflkistns
 1021 vvtgclqlnv cnsnpclhgg ncediyssyh cscplgwsgk hcelnidecf snpcihgncs
 1081 drvaayhctc epgytgvnce vdidncqshq cangatcish tngysclcfg nftgkfcrqs
 1141 ripstvcgne ktnltcynggncrefqtelk cmcrpgftge wcekdideca sdpcvnggle
 1201 qdllnkfqcl cdvafagerc evdladdlis difttigsvt valllillla ivasvvtsnk
 1261 ratqgtysps rqekegsrve mwnlmpppam erli
```

SEQ ID NO: 47 Human CRB1 cDNA Sequence Variant 3 (NM_001257965.1, CDS: from 340 to 4488)
```
    1 atgtgcgcgc acgccgcttt acgcatgctc cttaagttcc ccgtactccc tcggagaccc
   61 tagctacacg ccgaatccgt tactccgggt tttcgcagtg gtccggtggc ctaccccgat
  121 cgaaacctag tctggaactg aacctacaat atctctgagg gaggacacat ctatgactag
  181 cagtggcatg tgctcaggaa agattccttt tgcaataaaa acaacaccag gtgcctctca
  241 aattcttgcc aaaacaattc tacatgcaaa gattttcaa aagacaatga ttgttcttgt
  301 tcagacacag ccaataattt ggacaaagac tgtgacaaca tgaaagaccc ttgcttctcc
  361 aatccctgtc aaggaagtgc cacttgtgtg aacacccag gagaaaggag cttctgtgc
  421 aaatgtcctc ctgggtacag tgggacaatc tgtgaaacta ccattggttc ctgtggcaag
  481 aactcctgcc aaacatggag tatttgccat caggaccgta tttatcctgt ctgcatctgc
  541 cctgctggat atgtcggaag attctgtgag atagatcacg atgagtgtgc ttccagccct
  601 tgccaaaatg gggccgtgtg ccaggatgga atcgatggtt actcctgctt ctgtgtccca
  661 ggatatcaag gcagacactg cgacttggaa gtggacgaat gtgcttcaga tcctgcaag
  721 aacgaggcta catgcctcaa tgaaatagga acatatctgt catatctgtcc ccacaattat
  781 tctggtgtaa actgtgaatt ggaaattgac aatgttggt cccagccttg ttaaatggt
  841 gcaacttgtc aggacgctct gggggcctat ttctgcgacc gtgccctgg attcctgggg
  901 gatcactgtg aactcaacac tgatgagtgt gccagtcaac cttgtctcca tggagggctg
  961 tgtgtgatg gagaaaacag atatagcgt aactgcacgg gtagtggatt cacagggaca
 1021 cactgtgaga cctgatgcc tctttgttgg tcaaaacctt gtcacaataa tgctacatgt
 1081 gaggacagtg ttgacaatta cacttgtcac tgctggcctg gatacacagg tgcccagtgt
 1141 gagatcgacc tcaatgaatg caatagtaac ccctgccagt ccaatgggga atgtgtggag
 1201 ctgtcctcag agaaacaata tggacgcatc actggactgc cttcttcttt cagctaccat
 1261 gaagcctcag gttatgtctg tatctgtcag cctggattca caggaatcca ctgcgaagaa
 1321 gacgtcaatg aatgttcttc aaacccttgc caaaatggtg gtacttgtga gaacttgcct
 1381 gggaattata cttgccattg cccatttgat aacctttcta gaacttttta tggaggaagg
 1441 gactgttctg atattctcct gggctgtacc catcagcaat gtctaaataa tggaacatgc
 1501 atccctcact tccaagatgg ccagcatgga ttcagctgcc tgtgtccatc tggctacacc
```

TABLE 1-continued

```
1561 gggtccctgt gtgaaatcgc aaccacactt tcatttgagg gcgatggctt cctgtgggtc
1621 aaaagtggct cagtgacaac caagggctca gtttgtaaca tagccctcag gtttcagact
1681 gttcagccaa tggctcttct acttttccga agcaacaggg atgtgtttgt gaagctggag
1741 ctgctaagtg gctacattca cttatcaatt caggtcaata atcagtcaaa ggtgcttctg
1801 ttcatttccc acaacaccag cgatggagag tggcatttcg tggaggtaat atttgcagag
1861 gctgtgaccc ttaccttaat cgacgactcc tgtaaggaga aatgcatcgc gaaagctcct
1921 actccacttg aaagtgatca atcaatatgt gcttttcaga actcctttt gggtggttta
1981 ccagtgggaa tgaccagcaa tggtgttgct ctgcttaact tctataatat gccatccaca
2041 ccttcgtttg taggctgtct ccaagacatt aaaattgatt ggaatcacat taccctggag
2101 aacatctcgt ctggctcatc attaaatgtc aaggcaggct gtgtgagaaa ggattggtgt
2161 gaaagccaac cttgtcaaag cagaggacgc tgcatcaact tgtggctgag ttaccagtgt
2221 gactgccaca ggccctgatga aggccccaac tgtctgagag agtatgtggc aggcagattt
2281 ggccaggatg actccactgg ttatgtcatc tttactcttg atgagagcta tggagacacc
2341 atcagcctct ccatgtttgt ccgaacgctt caaccatcag gcttacttct agcttttggaa
2401 aacagcactt atcaatatat ccgtgtctgg ctagagcgcg gcagactagc aatgctgact
2461 ccaaactctc ccaaattagt agtaaaattt gttcttaatg atggaaatgt ccacttgata
2521 tctttgaaaa tcaagccata taaaattgaa actgtatcgat cttcacaaaa cctaggattt
2581 atttctgctt ctacgtggaa aatcgaaaag ggagatgtca tctacattgg tggcctacct
2641 gacaagcaag agaccgaact taatggtgga ttcttcaaag gctgtatcca agatgtaaga
2701 ctaaacaacc aaaatctgga attctttcca aatccaacaa acaatgcatc tctcaatcca
2761 gttcttgtca atgtaaccca aggctgtgct ggagacaaca gctgcaagag gcagaccaat
2821 gtgggaaggg cactcactga gttgggatcc agaggaccta agtaccaagt ttcactgttt
2881 cgcttctgtg taggatcttg ggcaactgga aacaccttct ttttatcatc tataaaacca
2941 ggatccaacc cctgtcacaa tggaggtgtt tgccattccc ggtgggatga cttctcctgt
3001 tcctgtcctg ccctcacaag tgggaaagcc tgtgaggagg ttcagtggtg tggattcagc
3061 ccgtgtcctc acggagccca gtgccagccg gtgcttcaag gatttgaatg tattgcaaat
3121 gctgttttta atggacaaag cggtcaaata ttattcagaa gcaatgggaa tattaccaga
3181 gaactcacca atatcacatt tggtttcaga acaagggatg caaatgtaat aatattgcat
3241 gcagaaaaag agcctgaatt tcttaatatt gcattcaag attccagatt attctttcaa
3301 ttgcaaagtg gcaacagctt ttatatgcta agtctgacaa gtttgcagtc agtgaatgat
3361 ggcacatggc acgaagtgac cctttccatg acagacccac tgtcccagac ctccaggtgg
3421 caaatggaag tggacaacga aacaccttt gtgaccagca caattgctac tggaagcctc
3481 aactttttga aggataatac agatatttat gtgggagaca gagctattga caatataaag
3541 ggcctgcaag ggtgtctaag tacaatagaa atcggaggca tttatctctc ttactttgaa
3601 aatgttcacg gtttcattaa taaacctcag gaagagcaat ttctcaaaat ctctaccaat
3661 tcagtggtca ctggctgttt gcagttaaat gtctgcaact ccaaccctg tttgcatgga
3721 ggaaactgtg aagacatcta tagctcttat cattgctcct gtccctgggg atggtcaggg
3781 aaacactgtg aactcaacat cgatgaatgc tttcaaacc cctgtatcca tggcaactgc
3841 tctgacagag ttgcagccta ccactgcaca tgtgagcctg gatacactgg tgtgaactgt
3901 gaagtggata tagacaactg ccagagtcac cagtgtgcaa acggagccac ctgccattagt
3961 catactaatg gctattcttg cctctgtttt ggaaattta caggaaaatt ttgcagacag
4021 agcagattac cctcaacagt ctgtgggaat gagaagcaaa atctcacttg ctacaatgga
4081 ggcaactgca cagagttcca gactgaatta aaatgtatgt gccggccagg ttttactgga
4141 gaatggtgtg aaaaggacat tgatgagtgt gcctctgatc cgtgtgtcaa tggaggtctg
4201 tgccaggact tactcaacaa attccagtgc ctctgtgatg ttgcctttgc tggcgagcgc
4261 tgcgaggtgg acttggcaga tgacttgatc tccgacattt tcaccactat tggctcagtg
4321 actgtcgcct tgttactgat cctcttgctg gccattgttg cttctgttgt cacctccaac
4381 aaaagggcaa ctcagggaac ctacagcccc agccgtcagg agaaggaggg ctcccgagtg
4441 gaaatgtgga acttgatgcc accccctgca atggagagac tgatttagga gcattgtgtc
4501 ccttcgagat ggggatccaa acactgtgaa tgtgatgact gtacttcagg tatctctgac
4561 atacctgaca atgttaatct gcaactggga ttacactgga actacaggaa tgattccttt
4621 gaccaccta aaaacttca cagtgggttcc gctcgacacc attgttttat tatattat
4681 cagccaattg caaaaaaagt ctgtgccagt aatttcagcc ttataattag caaaaacatc
4741 ttccagagaa taaagtcctc tgtggcttta gtggctatca ctgaaactct ttcctcttt
4801 caacctggga acaaattta gttttcattt taggtttctg tactttctgt agtttctgtg
4861 taaactgcca tatgtttaca tggaaactac aggaaaaaat tggctacatt tctcacttct
4921 cctatcatgt ggtcaaagtt attgttgtat accagcgatg ggatgtatac ttttgtcctt
4981 cattcatgga ttcagagaaa gctctgggaa tgacttatgg tccaaaaaag tgacccaatg
5041 gcaacaaata aaaattgaaa tgcaaaaaaa aaaaaaaaaa aa
```

SEQ ID NO: 48 Human CRB1 Amino Acid Sequence Isoform C (NP_001244894.1)

```
   1 mkdpcfsnpc qgsatcvntp gersflckcp pgysgticet tigscgknsc qhggichqdp
  61 iypvcicpag yagrfceidh decasspcqn gavcqdgidg yscfcvpgyq grhcdlevde
 121 casdpcknea tclneigryt cicphnysgv nceleidecw sqpclngatc qdalgaytcd
 181 capgflgdhc elntdecasq pclhgglcvd genrysccnct gsgftgthce tlmplcwskp
 241 chnnatceds vdnytchcwp gytgaqceid lnecsnspcq sngecvelss ekqygritgl
 301 pssfsyheas gyvcicqpgf tgihceedvn ecssnpcqng gtcenlpqnc tchcpfdnls
 361 rtfyggrdcs dillgcthqq clnngtciph fqdgqhgfcs lcpsgytgsl ceiattlste
 421 gdgflwvksg svttkgsvcn ialrfqtvqp mallfrsnr dvfvklells gyihlsiqvn
 481 nqskvllfis hntsdgewhf vevifaeavt ltliddscke kciakaptpl esdqsicafq
 541 nsflgglpvg mtsngvalln fynmpstpsf vgclqdikid wnhitlenis sgsslnvkag
 601 cvrkdwcesq pcqsrgrcin lwlsyqcdch rpyegpnclr eyvagrfgqd dstgyviftl
 661 desygdtisl smfvrtlqps glllalenst yqyirvwler grlamltpns pklvvkfvln
 721 dgnvhlislk ikpykielyq ssqnlgfisa stwkiekgdv iyigglpdkq etelnggffk
 781 gciqdvrlnn qnletfpnpt nnaslnpvlv nvtqgcagdn sckrqtnvgr altelgsrgp
 841 kyqvslfrfc vgswatgntf flssikpgsn pchnggvchs rwddlscscp altsgkacee
 901 vqwcgfspcp hgaqcqpvlq gfecianavf ngqsgqilfr sngnitrelt nitfgfrtrd
 961 anviilhaek epeflnisiq dsrlffqlqs gnsfymlslt slqsvndgtw hevtlsmtdp
1021 lsqtsrwqme vdnetpcfvts tiatgslnfl kdntdiyvgd raidnikglq gclstieigg
1081 iylsyfenvh gfinkpqeeq flkistnsvv tgclqlnvcn snpclhggnc ediyssyhcs
```

TABLE 1-continued

```
1141 cplgwsgkhc elnidecfsn pcihgncsdr vaayhctcep gytgvncevd idncqshqca
1201 ngatcishtn gysclcfgnf tgkfcrqsrl pstvcgnekt nltcynggnc tefqtelkcm
1261 crpgftgewc ekdidecasd pcvngglcqd llnkfqclcd vafagercev dladdlisdi
1321 fttigsvtva llliilllaiv asvvtsnkra tqgtyspsrq ekegsrvemw nlmpppamer
1381 li
```

SEQ ID NO: 49 Human CRB1 cDNA Sequence Variant 4 (NM_001257966.1., CDS: from 210 to 2822)
```
   1 cctcccgtgt aagtgatgct aagaagcaca aactgcattt tgaatctaag tccctgtatt
  61 ttctgtgaag gagctgtaag tagggtggga cagagatggc acctggggt tctgaggcac
  21 ccgctcctct ctgagacaga cagggatcag gagccggact gggaccagac caccagcaac
 181 acaccagagg atgttctcta aataagacca tggcacttaa gaacattaac taccttctca
 241 tcttctacct cagtttctca ctgcttatct acataaaaaa ttccttttgc aataaaaaca
 301 acaccaggtg cccctcaaat tcttgccaaa acaattctac acgcaaagat ttttcaaaag
 361 acaatgattg ttcttgttca gacacagcca ataatttgga caaagactgt gacaacatga
 421 aagaccttg cttctccaat ccctgtcaag gaagtgccac ttgtgtgaac accccaggag
 481 aaaggagctt tctgtgcaaa tgtcctcctg ggtacagtgg gacaatctgt gaaactacca
 541 ttggttcctg tggcaagaac tcctgccaac atggaggtat ttgccatcag gaccctattt
 601 atcctgtctg catctgccct gctggatatg ctggaagatt ctgtgagata gatcacgatg
 661 agtgtgcttc cagcccttgc caaaatgggg ccgtgtgcca ggatggaatt gatggttact
 721 cctgcttctg tgcccagga tatcaaggca gacactgcga cttggaagtg gatgaatgtg
 781 cttcagatcc ctgcaagaac gaggctacat gcctcaatga aataggaaga tatacttgta
 841 tctgtcccca caattattct ggtgtaaact gtgaattgga aattgacgaa tgttggtccc
 901 agccttgttt aaatggtgca acttgtcagg atgctctggg gcctatttc tgcgactgtg
 961 cccctggatt cctgggggat cactgtgaac tcaacactga tgagtgtgcc agtcaaccct
1021 gtctccatgg agggctgtgt gtggatggag aaaacagata tagctgtaac tgcacgggta
1081 gtggattcac agggacacac tgtgagacct tgatgcctct tgttggtca aaaccttgtc
1141 acaataatgc tacatgtgag gacagtgttg acaattacac ttgtcactgc tggcctggat
1201 acacaggtgc ccagtgtgag atcgacctca atgaatgcaa tagtaacccc tgccagtcca
1261 atggggaatg tgtggagctg tcctcagaga aacaatatgc acgcatcact ggactgcctt
1321 cttctttcag ctaccatgaa gcctcaggtt atgtctgtat ccgtcagcct ggattcacag
1381 gaatccactg cgaagaagac gtcaatgaat gttcttcaaa cccttgccaa aatggtggta
1441 cttgtgagaa cttgcctggg aattatactt gccattgccc atttgataac ctttctagaa
1501 cttttttatgg aggaagggac tgttctgata ttctcctggg ctgtacccat cagcaatgtc
1561 taaataatgg aacatgcatc cctcacttcc aagatggcca gcatggattc agctgcctgt
1621 gtccatctgg ctacaccggg tccctgtgtg aaatcgcaac cacactttca tttgagggcg
1681 atggcttcct gtgggtcaaa agtggctcag tgacaaccaa gggcccagtt tgtaacatag
1741 ccctccaggtt tcagactgtt cagccaatgg ctctcttact tttccgaagc aacagggatg
1801 tgtttgtgaa gctggagctg ctaagtggct acattcactt accaattcag gtcaataatc
1861 agtcaaaggt gcttctgttc atttcccaca acaccagcga tggagagtgg catttcgtgg
1921 aggtaatatt tgcagaggct gtgaccctta ccttaatcga cgactcctgt aaggagaaat
1981 gcatcgcgaa agtccctact ccacttgaaa gtgatcaatc aatatgtgct tttcagaact
2041 cctttttggg tggtttacca gtgggaatga ccagcaatgg tgttgctctg cttaacttct
2101 ataatatgcc atccacacct tcgtttgtag gctgtctcca agacattaaa attgattgga
2161 atcacattac cctggagaac atctcgtctg gctcatcatt aaatgtcaag gcaggctgtg
2221 tgagaaagga ttggtgtgaa agccaaccta gtcaaagcag aggacgctgc atcaacttgt
2281 ggctgagtta ccagtgtgac tgccacaggc cctacgaagg ccccaactgt ctgagaggaa
2341 aattttgcag acagagcaga ttaccctcaa cagtctgtgg gaatgagaag acaaatctca
2401 cttgctacaa tggaggcaac tgcacagagt tccagactga attaaaatgt atgtgccggc
2461 caggttttac tggagaatgc tgtgaaaagg acattgatga gtgtgcctct gatccgtgtc
2521 tcaatggagg tctgtgccag gacttactca caaaattcca gtgcctctgt gatgttgcct
2581 ttgctggcga gcgctgcgag gtggacttgg cagatgactt gatctccgac attttcacca
2641 ctattggctc agtgactgtc gccttgttac tgatcctctt gctggccatt gttgcttctg
2701 ttgtcacctc caacaaaagg gcaactcagg gaacctacag ccccagccgt caggagaagg
2761 agggctcccg agtggaaatg tggaacttga tgccaccccc tgcaatggag agactgattt
2821 aggagcattg tgtcccttcg agatggggat ccacacactg tgaatgtgat gactgtactt
2881 caggtatctc tgacatacct gacaatgtta atctgcaact gggattacac tggaactaca
2941 ggaatgattc ctttgaccac cttaaaaact ttcacagtgg ttccgctcga caccattgtt
3001 ttattatatt atatcagcca attgcaaaaa aagtctgtgc cagtaatttc agccttataa
3061 ttagcaaaaa catcttccag agaataaagt cttctgtggc tttagtggct atcactgaaa
3121 ctctttcctc ttttcaacct gggaacaaat tttagttttc attttaggtt tctgtactt
3181 ctgtagtttc tgtgtaaact gccatatgtt tacatggaaa ctacaggaaa aaattggcta
3241 catttctcac ttctcctatc atgtggtcaa agttattgtt gtataccagc gatgggatgt
3301 atactttgt ccttcattca tggattcaga gaaagctctg ggaacgactt atggtccaaa
3361 aaagtgaccc aatggcaaca aataaaaatt gaaatgcaaa aaaaaaaaa aaaaaa
```

SEQ ID NO: 50 Human CRD1 Amino Acid Sequence Isoform D (NP_001244895.1)
```
   1 malkninyll ifylsfslli yiknsfcnkn ntrclsnscq nnstckdfsk dndcscsdta
  61 nnldkdcdnm kdpcfsnpcq gsatcvnrpg ersflckcpp gysgticett igscgknscq
 121 hggichqdpi ypvcicpagy agrfceidhd ecasspcqng avcqdgidgy scfcvpgyqg
 181 rhcdlevdec asdpckneat clneigrytc icphnysgvn celeidecws qpclngatcq
 241 dalgayfcdc apgflgdhce lntdecasqp clhgglcvdg enryscnctg sgftgthcet
 301 lmplcwskpc hnnatcedsv dnytchcwpg ytgaqceidl necnsnpcqs ngecvelsse
 361 kqygritglp ssfsyheasg yvcicqpgft gihceedvne cssnpcqngg tcenlpgnyt
 421 chcpfdnlsr tfyggrdcsd illgcthqqc lnngtciphf qdgqhgfscl cpsgytgslc
 481 eiattlsfeg dgflwvksgs vttkgsvcni alrfqtvqpm alllfrsnrd vfvklellsg
 541 yihlsiqvnn qskvllfish ntsdgewhfv evifaeavtl tliddsckek ciakaptple
 601 sdqsicafqn sflgglpvgm tsngvallnf ynmpscpsfv gclqdikidw nhitleniss
 661 gsslnvkagc vrkdwcesqp cqsrgrcinl wlsyqcdchr pyegpnclrg kfcrqsrlps
 721 tvcgnektnl tcynggncte fqtelkcmcr pgftgewcek didecasdpc vngglcqdll
```

TABLE 1-continued

```
781 nkfqclcdva fagercevdl addlisdift tigsvtvall lilllaivas vvtsnkratq
841 gtyspsrqek egsrvemwnl mpppamerli
```

SEQ ID NO: 51 Mouse CRB1 cDNA Sequence (NM_133239.2, CDS: from 167 to 4384)

```
   1 gaagtgcttt ctgattctct gtctgtggag gagccctggg aggggtggga cagagatggc
  61 atcctggctc tctgaggcac ctgctcttct ctgaaccaca caggagtcaa gagccaaaca
 121 gggatagctt cagcagcact tcagagggtg ttctctaagt aagaacatga agctcaagag
 181 aactgcctac cttctcttcc tgtacctcag ctcctcactg ctcatctgca taaagaattc
 241 attttgcaat aaaaacaata ccaggtgcct ttcaggtcct tgccaaaaca attctacgcg
 301 caagcatttt ccacaagaca acaattgttg cttagacaca gccataatt tggacaaaga
 361 ctgtgaagat ctgaaagacc cttgcttctc gagtccctgc caaggaattg ccacttgtgt
 421 gaaaatccca gggaaggga acttcccgtg tcagtgtcct cctgggtaca gcgggctgaa
 481 ctgtgaaact gccaccaatt cctgtggagg gaacctctgc caacatgag gcacctgccg
 541 taaagaccct gagcaccctg tctgtatctg ccctcctgga tatgctggaa ggttctgtga
 601 gactgatcac aatgagtgtg cttctagccc ttgccacaat ggggctatgt gccaggatgg
 661 aatcaatggc tactcctgct tctgtgtgcc tggataccaa ggcaggcatt gtgacttgga
 721 agtggatgaa tgtgtttctg atccctgcaa gaatgaggct gtgtgcctca atgagatagg
 781 aagatacact tgtgtctgcc ctcaagagtt ttctggcgtg aactgtgagt tggaaattga
 841 tgaatgcaga tcccagcctt gtctccacgg tgccacatgt caggacgctc caggggggcta
 901 ctcctgtgac tgtgcacctg gattccttgg agagcactgt gaactcagcg ttaatgaatg
 961 tgaaagtcag ccgtgtctcc atggaggtct atgtgtggat ggaagaaaca gttaccactg
1021 tgactgcaca ggtagtggat tcacagggat gcactgtgag tccttgattc ctctttgttg
1081 gtcaaagcct tgtcacaacg acgcgacatg tgaagatact gttgacagct atattttgtca
1141 ctgccggcct ggatacacag gtgccctgtg tgagacagac ataaatgaat gcagtagcaa
1201 cccctgccaa ttttggggg aatgtgtcga gctgtcctca gagggtctat atggaaacac
1261 tgctggcctg ccttcctcct tcagctatgt tggagcctcg ggctatgtgt gtatctgtca
1321 gcctggattc acaggaattc actgtgaaga agacgttgat gaatgtttac tgcacccttg
1381 cctaaatggt ggtacttgtg agaacctgcc tgggaattat gcctgtcact gtccctttga
1441 tgacacttct aggacatttt atggaggaga aaactgctca gaaattctcc tgggctgcac
1501 tcatcaccag tgtctgaaca atggaaaatg tatccctcat tcccaaaatg gccagcatgg
1561 attcacttgc cagtgtcttt ctggctatgc ggggcccctg tgtgaaactg tcaccacact
1621 ttcatttggg agcaatggct tcctatgggt cacaagtggc tcccatacag gcatagggcc
1681 agaatgtaac atatccttga ggtttcacac tgttcaacca aacgcacttc tcctcatccg
1741 aggcaacaag gacgtgtcta tgaagctgga gttgctgaat ggttgtgttc acttatcaat
1801 tgaagtctgg aatcagttaa aggtgctcct gtctatttct cacaacacca gtgatggaga
1861 atggcatttc gtggaggtaa caatcgcaga aactccaacc cttgccctag ttggcggctc
1921 ctgcaaggag aagtgcacca ccaagtcttc tgttccagtt gagaatcatc aatcaatatg
1981 tgctttgcag gactcttttt tgggtggctt accaatgggg acagccaaca acagtgtgtc
2041 tgtgcttaac atctataatg tgccgtccac accttccttt gtaggctgtc tccaagacat
2101 tagatttgat ttgaatcaca ttactctgga gaacgtttca tctggcctgt catcaaatgt
2161 taaagcaggc tgcctgggaa aggactggtg tgaaagtcaa ccctgtcaaa acagaggacg
2221 ctgcatcaac ttgtggcagg gttatcagtg tgaatgtgac aggcccctata caggctccaa
2281 ctgcctgaaa gagtatgtag cgggaagatt tggccaagat gactccacag gatatgcggc
2341 cttttagtgtt aatgataatt atggacagaa cttcagtctt tcaatgtttg tccgaacacg
2401 tcaaccctg ggcttacttc tggcttttga aaatagtact taccagtatg tcagtgtctg
2461 gctagagcac ggcagcctag cactgcagac tccaggctct cccaagttca tggtaaactt
2521 ttttctcagt gatggaaatg ttcacttaat atctttgaga atcaaaccaa atgaaattga
2581 actgtatcag tcttcacaaa acctaggatt catttctgtt cctacatgga caattcgaag
2641 aggagacgtc atcttcattg gtggcttacc tgacagagag aagctgaaa tttatggtgg
2701 cttcttcaaa ggctgtgttc aagatgtcag attaaacagc cagactctgg aattcttttcc
2761 caattcaaca aacaatgcat acgatgaccc aattcttgtc aatgtgactc aaggctgtcc
2821 cggagacaac acatgtaagt ccaacccctg tcataatgga ggtgtctgcc actccctgtg
2881 ggatgacttc tcctgctccc gccctacaaa cacagcgggg agagcctgcg agcaagttca
2941 gtggtgtcaa ctcagcccat gtcctcccac tgcagagtgc cagctgctcc ctcaagggtt
3001 tgaatgtatc gcaaacgctg ttttcagcgg attaagcaga gaaatactct tcagaagcaa
3061 tgggaacatt accagagaac tcaccaatat cacatttgct ttcagaacac atgatacaaa
3121 tgtgatgata ttgcatgcag aaaaagaacc agagtttctt aatattagca ttcaagatgc
3181 cagattattc tttcaattgc gaagtggcaa cagctttttat acgctgcacct tgatggggttc
3241 ccaattggtg aatgatggca catggcacca agtgactttc tccatgatag acccagtggtc
3301 ccagacctcc cggtggcaaa tggaggtgaa cgaccagaca ccctttgtga taagtgaagt
3361 tgctactgga agcctgaact ttttgaagga caatacgac atctatgtgg gtgaccaatc
3421 tgttgacaat ccgaaaggcc tgcagggctg tctgagcaca atagagattg gaggcatata
3481 tctttcttac tttgaaaatc tacatggttt ccctggtaag cctcaggaag agcaatttct
3541 caaagtttct acaaatatgg tacttactgg ctgttttgcca tcaaatgcct gccactccag
3601 cccctgtttg catggaggaa actgtgaaga cagctacagt tcttatcggt gtgcctgtct
3661 ctcgggatgg tcagggacac actgtgaaat caacattgat gagtgctttt ctagcccccg
3721 tatccatggc aactgctctg atggagttgc agcctaccac tgcaggtgtg agcctggata
3781 caccggtgtg aactgtgagg tggatgtaga caattgcaag agtcatcagt gtgcaaatgg
3841 ggccaccgt gttcctgaag ctcatggcta ctcttgtctc tgctttggaa attttaccgg
3901 gagatttgc agacacagca gattaccctc aacagtctgt gggaatgaga agagaaactt
3961 cacttgctac aatggaggca gctgctccat gttccaggag gactgcaat gtatgtgctc
4021 gccaggtttc actggagagt ggtgtgaaga ggacatcaac gagtgtgcct ccgatccctg
4081 catcaatgga ggactgtgca gggacttggt caacaggttc ctatgcatct gtgatgtggc
4141 cttcgctggc gagcgctgtg agctggacct ggctgatgac aggctcctgg gcatttcac
4201 cgctgtttgc tccggaactt tggccctgtt cttcatcctc ttgcttgctg gggttgcttc
4261 tcttattgcc tccaacaaaa gggcgactca aggaacctac agccccagcg tcaggagaa
4321 ggctggccct cgagtggaaa tgtggatcag gatgccgccc ccggcactgg aaaggctcat
4381 ctaggagact gctgctcttc tcaggacaga gaagaacatg atgagtaccg ggtcgtgcct
4441 gagtgaagat ggcttttacat cactagagat acatacagct gggactgtgg gaaggacctt
```

TABLE 1-continued

```
4501 cctgtggagt cactgagtag ttatgtcatc cattcacaga agagtgtccc tgtgtttgcc
4561 tgtcagcctc agaattagca aaacatctag cagacagaga acacagtatt tcagaagaac
4621 tccagaggct gcccttaaa ctctttactg gttgatccac ataaaatgct tagtagccaa
4681 gtgccattaa ttatacagag cc
```

SEQ ID NO: 52 Mouse CRB1 Amino Acid Sequence (NP_573502.2)
```
   1 mklkrtayll flylssslli ciknsfcnkn ntrclsgpcq nnstckhfpq dnnccldtan
  61 nldkdcedlk dpcfsspcqg iatcvkipge gnflcqcppg ysglncetat nscggnlcqh
 121 ggtcrkdpeh pvcicppgya grfcetdhne casspchnga mcqdgingys cfcvpgyqgr
 181 hcdlevdecv sdpckneavc lneigrytcv cpqetsgvnc eleidecrsq pclhgatcqd
 241 apggyscdca pgflgehcel svnecesqpc lhgglcvdgr nsyhcdctgs gftgmhcesl
 301 iplcwskpch ndatcedtvd syichcrpgy tgalcetdin ecssnpcqfw gecvelsseg
 361 lygntaglps sfsyvgasgy vcicqpgftg ihceedvdec llhpclnggt cenlpgnyac
 421 hcptddtsrt fyggencsei llgcthhqcl nngkciphfq ngqhgftcqc lsgyagplce
 481 tvttlsfgsn gflwvtsgsh tgigpecnis lrfhtvqpna llirgnkdv smklellngc
 541 vhlsievwnq lkvllsishn tsdgewhfve vtiaetltia lvggsckekc ttkssvpven
 601 hqsicalqds flgglpmgta nnsvsvlniy nvpstpsfvg clqdirfdln hitlenvssg
 661 lssnvkagcl gkdwcesqpc qnrgrcinlw qgyqcecdrp ytgsnclkey vagrfgqdds
 721 tgyaafsvnd nygqnfslsm fvrtrqplgl llalenstyq yvsvwlehgs lalqtpgspk
 781 fmvnfflsdg nvhlislrik pneielyqss qnlgfisvpt wtirrgdvif igglpdrekt
 841 evyggffkgc vqdvrlnsqt leffpnstnn ayddpilvnv tqgcpgdntc ksnpchnggv
 901 chslwddfsc scptntagra ceqvqwcqls pcpptaecql lpqgfecian avfsglsrei
 961 lfrsngnitr eltnitfafr thdtnvmilh aekepeflni siqdarlffq lrsgnsfytl
1021 hlmgsqlvnd gtwhqvtfsm idpvaqtsrw qmevndqtpf visevatgsl nflkdntdiy
1081 vgdqsvdnpk glqgclstie iggiylsyfe nlhgfpgkpg eeqflkvstn mvltgclpsn
1141 achsspclhg gncedsyssy rcaclsgwsg thceinidec fsspcihgnc sdgvaayhcr
1201 cepgytgvnc evdvdncksh qcangatcvp eahgyscclcf gnftgrfcrh srlpstvcgn
1261 ekrnftcyng gscsmfqedw qcmcwpgftg ewceedinec asdpcinggl crdlvnrflc
1321 icdvafager celdladdrl lgiftavgsg tlalffilll agvasliasn kratqgtysp
1381 sgqekagprv emwirmpppa lerli
```

SEQ ID NO: 53 Human BRG1 cDNA Sequence Variant 1 (NM_001128849.1, CDS: from 75 to 5114)
```
   1 ggcgggggag gcgccgggaa gtcgacgcg ccggcggctc ctgcaggagg ccactgtctg
  61 cagctcccgt gaagatgtcc actccagacc cacccctggg cggaactcct cggccaggtc
 121 cttccccggg ccctggccct tccctggag ccatgctggg ccctagcccg gtccctcgc
 181 cgggctccgc ccacagcatg atggggccca gcccaggccc gccctcagca ggacaccca
 241 tccccaccca ggggcctgga gggtaccctc aggacaacat gcaccagatg cacaagccca
 301 tggagtccat gcatgagaag ggcatgtcgg acgacccgcg ctacaaccag atgaaaggaa
 361 tggggatgcg gtcagggggc catgctggga tggggcccc gcccagcccc atggaccagc
 421 actcccaagg ttaccctcg cccctgggtg gctctgagca tgcctctagt ccagttccag
 481 ccagtggcc gtctccgggg cccagatgt ctcccgggca ggaggtgcc ccgctggatg
 541 gtgctgaccc ccaggcctg gggcagcaga accgggccc aaccccattt aaccagaacc
 601 agctgcacca gctcagagct cagatcatgg cctacaagat gctggcaggg gggcagcccc
 661 tccccgacca cctgcagatg gcggtgcagg gcaagcggcc gatgcccggg atgcagcagc
 721 agatgccaac gctacctcca ccctcggtgt ccgcaacagg accggccct ggccctggcc
 781 ctggccccgg cccgggtccc ggcccggcac ctccaaatta cagcaggcct catggtatgg
 841 gagggcccaa catgcctccc ccaggaccct cgggcgtgcc cccgggatg ccaggccagc
 901 ctcctggagg gcctcccaag ccctggcctg aaggaccat ggcgaatgct gctgcccca
 961 cgagcacccc tcagaagctg attcccccgc agcaaacggg ccgccccttc ccccgcccc
1021 ctgccgtccc accgccgcc tcgccgtga tgccaccgca gacccagtcc cccgggcagc
1081 cggccgcagcc cgcgcccatg gtgccactgc accagaagca gagccgcatc ccccccatcc
1141 agaagccgcg gggcctcgac cctgtggaga tcctgcagga gcgcgagtac aggctgcagg
1201 ctcgcatcgc acaccgaatt caggaacttg aaaaccttcc cgggtccctg gcgcggggatt
1261 tgcgaaccaa agcgaccatt gagctcaagg ccctcaggct gctgaacttc cagaggcagc
1321 tgcgccagga ggtggtggtg tgcatgcgga gggacacagc gctggagaca gccctcaatg
1381 ctaaggccta caagcgcagc aagcgccagt ccctgcgcga ggcccgcacc actgagaagc
1441 tggagaagca gcagaagatc gagcaggagc gcaagcgccg gcagaagcac caggaatacc
1501 tcaatagcat tctccagcat gccaaggatt tcaaggaata tcacagatcc gtcacaggca
1561 aaatccagaa gctgaccaag gcagtggcca cgtaccatgc caacacggag cgggagcaga
1621 agaaagaaa cgagcggatc gagaaggagc gcatgcggag gctcatggct gaagatgagg
1681 aggggtaccg caagctcatc gaccagaaga ggacaagcg cctggcctac ctcttgcagc
1741 agacagacga gcacgtggct aacctcacgg agctggtgcg gcagcacaag gctgcccagg
1801 tcgccaagga gaaaaagaag aaaaagaaaa agaagaaggc agaaaatgcc gaaggacaga
1861 cgcctgccat tgggccggat ggcgagcctc tggacgagac cagccagatg agcgacctcc
1921 cggtgaaggt gatccacgtg gagagtggga gatcctcac aggcacagat gccccaaag
1981 ccgggcagct ggaggccctgg ctcgagatga acccggggta tgaagtgcct ccgaggtctg
2041 atagtgaaga agtggctca gaagaagagg aagaggagga ggaggaagag cagccgcagg
2101 cagcacagcc tcccaccctg ccgtggagg agaagaagaa gattccagat ccagacagcg
2161 atgacgtctc tgaggtggac gcgcggcaca tcattgaaa tgccaagcaa gatgtcgatg
2221 atgaatatgg cgtgtcccag gcccttgcac gtggcctgca gtcctactat gccgtggccc
2281 atgctgtcac tgagagagtg gacaagcagt cagcgcttat ggtcaatgct gtcctcaaac
2341 agtaccagat caaaggtttg gagtggctgg tgtccctgta caacaacaac ctgaacggca
2401 tcctggccga cgagatgggc ctggggaaga ccatccagac catcgcgctc atcacgtacc
2461 tcatggagca caaacgcatc aatggccct tcctcatcat cgtgcctctc tcaacgctgt
2521 ccaactgggc gtacgagttt gacaagtggg ccccctccgt ggtgaaggtg tcttacaagg
2581 gatcccagc agcaagacgg gcctttgtcc cccagctccg gagtgggaag ttcaacgtct
2641 tgctgacgac gtacgagtac atcatcaaag acaagcacat cctcgccaag atccgttgga
2701 agtacatgat tgtggacgaa ggtcaccgca tgaagaacca ccactcaag ctgacgcagg
2761 tgctcaacac gcactatgtg gcaccccgcc gctgctgct gacgggcaca ccgctgcaga
```

TABLE 1-continued

```
2821 acaagcttcc cgagctctgg gcgctgctca acttcctgct gcccaccatc ttcaagagct
2881 gcagcacctt cgagcagtgg tttaacgcac cctttgccat gaccggggaa aaggtggacc
2941 tgaatgagga ggaaaccatt ctcatcatcc ggcgtctcca caaagtgctg cggcccttct
3001 tgctccgacg actcaagaag gaagtcgagg cccagttgcc cgaaaaggtg gagtacgtca
3061 tcaagtgcga catgtctgcg ctgcagcgag tgctctaccg ccacatgcag gccaagggcg
3121 tgctgctgac tgatggctcc gagaaggaca agaagggcaa aggcggcacc aagaccctga
3181 tgaacaccat catgcagctg cggaagatct gcaaccaccc ctacatgttc cagcacatcg
3241 aggagtcctt ttccgagcac ttggggttca ctggcggcat tgtccaaggg ctggacctgt
3301 accgagcctc gggtaaattt gagcttcttg atagaattct tcccaaactc cgagcaacca
3361 accacaaagt gctgctgttc tgccaaatga cctccctcat gaccatcatg gaagattact
3421 ttgcgtatcg cggcttttaaa tacctcaggc ttgatggaac cacgaaggcg gaggaccggg
3481 gcatgctgct gaaaaccttc aacgagcccg gctctgagta cttcatcttc ctgctcagca
3541 cccgggctgg ggggctcggc ctgaacctcc agtcggcaga cactgtgatc attttgaca
3601 gcgactggaa tcctcaccag gacctgcaag cgcaggaccg agcccaccgc atcgggcagc
3661 agaacgaggt gcgtgtgctc cgcctctgca ccgtcaacag cgtggaggag aagatcctag
3721 ctgcagccaa gtacaagctc aacgtggacc agaaggtgat ccaggccggc atgttcgacc
3781 agaagtcctc cagccatgac cggcgcgcct tcctgcaggc catcctggag caggaggagc
3841 aggatgagag cagacactgc agcacgggca gcggcagtgc cagcttcgcc cacactgccc
3901 ctccgccagc gggcgtcaac cccgacttgg aggagccacc tctaaaggag gaagacgagg
3961 tgcccgacga cgagaccgtc aaccagatga tcgcccggca cgaggaggag ttgatctgt
4021 tcatgcgcat ggacttggac cgcaggccgg aggaggcccg caacccaag ggaagccgc
4081 gcctcatgga ggaggacgag ctcccctcgt ggatcatcaa ggacgacgcg gaggtggagc
4141 ggctgacctg tgaggaggag gaggagaaga tgttcggccg tggctcccgc caccgcaagg
4201 aggtggacta cagcgactca ctgacggaga agcagtggct caagaaaatt acaggaaaag
4261 atatccatga cacagccagc agtgtggcac gtgggctaca attccagcgt ggccttcagt
4321 tctgcacacg tgcgtcaaag gccatcgagg agggcacgct ggaggagatc gaagaggagg
4381 tccggcagaa gaaatcatca cggaagcgca agcgagacag cgacgccggc tcctccaccc
4441 cgaccaccag caccccgcag cgcgacaagg acgacgagag caagaagcag aagaagcgcg
4501 ggcggccgcc tgccgagaaa ctctcccccta acccacccaa cctcaccaag aagatgaaga
4561 agattgtgga tgccgtgatc aagtacaagg acagcagcag tggacgtcag ctcagcgagg
4621 tcttcatcca gctgccctcg cgaaaggagc tgcccgagta ctacgagctc atccgcaagc
4681 ccgtggactt caagaagata aaggagcgca ttcgcaacca caagtaccgc agcctcaacg
4741 acctagagaa ggacgtcatg ctcctgtgcc agaacgcaca gaccttcaac ctggagggct
4801 ccctgatcta tgaagactcc atcgtcttgc agtcggtctt caccagcgtg cggcagaaaa
4861 tcgagaagga ggatgacagt gaaggcgagg agagtgagga ggaggaagag ggcgaggagg
4921 aaggctccga atccgaatct cggtccgtca aagtgaagat caagcttggc cggaaggaga
4981 aggcacagga ccggctgaag ggcggccggc ggcggccgag ccgagggtcc cgagccaagc
5041 cggtcgtgag tgacgatgac agtgaggagg aacaagagga ggaccgctca ggaagtggca
5101 gcgaagaaga ctgagccccg acattccagt ctcgaccccg agccctcgt tccagagctg
5161 agatggcata ggccttagca gtaacgggta gcagcagatg tagcttcaga cttggagtaa
5221 aactgtataa acaaaagaat cttccatatt tatacagcag agaagctgta ggactgtttg
5281 tgactgccc tgccctggca tcagtagcat ctgtaacagc attaactgtc ttaaagagag
5341 agagagagaa tcccgaattg gggaacacac gatacctgtt tttctttcc gttgctggca
5401 gtactgttgc gccgcagttt ggagtcactg tagttaagtg tggatgcatg tgcgtcaccg
5461 tccactcctc ctactgtatt ttattggaca ggtcagactc gccgggggcc cggcgagggt
5521 atgtcagtgt cactggatgt caaacagtaa taaattaaac caacaacaaa acgcacagcc
5581 aaaaaaaaaa
```

SEQ ID NO: 54 Human BRG1 Amino Acid Sequence Isoform A (NP_001122321.1, CDS: from 75 to 5114)

```
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 raqimaykml argqplpdhl qmavqgkrpm pgmqqqmptl pppsvsatgp gpgpgpgpgp
 241 gpgpappnys rphgmggpnm pppgpsgvpp gmpgqppggp pkpwpegpma naaaptstpq
 301 klippqptgr pspappavpp aaspvmppqt qspgqpaqpa pmvplhqkqs ritpiqkprg
 361 ldpveilqer eyrlqariah riqelenlpg slagdlrtka tielkalrll nfqrqlrqev
 421 vvcmrrdtal etalnakayk rskrqslrea riteklekqq kieqerkrrq khqeylnsil
 481 qhakdfkeyh rsvtgkiqkl tkavatyhan tereqkkene riekermrrl maedeegyrk
 541 lidqkkdkrl ayllqqtdey vanltelvrq hkaaqvakek kkkkkkkkae naegqtpaig
 601 pdgepldets qmsdlpvkvi hvesgkiltg tdapkagqle awlenmpgye vaprsdsees
 661 gseeeeeeee eeqpaaqpp tlpveekkki pdpdsddvse vdarhiiena kqdvddeygv
 721 sqalarglqs yyavahavte rvdkqsalmv ngvlkqyqlk glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvlnth
 901 yvaprrlllt gtplqnklpe lwallnfllp tifkscstfe qwfnapgamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcqmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmtdqksss herraflqai leheeqdesr
1261 hcstgsgsas fahtapppag vnpdleeppl keedevpdde tvnqmiarhe eefdlfmrmd
1321 ldrrreearn pkrkprlmee delpswiikd daeverltce eeeekmfgrg srhrkevdys
1381 dsltekqwlk kitgkdihdt assvarglqf qrglqfctra skaieegtle eieeevrqkk
1441 ssckrkrdsd agsstpttst rsrdkddesk kqkkrgrppa eklspnppnl tkkmkkivda
1501 vikykdsssg rqlsevfiql psrkelpeyy elirkpvdfk kikerirnhk yrslndlekd
1561 vmllcqnaqt fnlegsliye dsivlqsvft svrqkieked dsegeeseee eegeeegses
1621 esrsvkvkik lgrkekaqdr lkggrrrpsr gsrakpvvsd ddseeeqeed rsgsgseed
```

TABLE 1-continued

SEQ ID NO: 55 Human BRG1 cDNA Sequence Variant 2 (NM_001128844.1, CDS: from 361 to 5304)

```
   1 ggagaggccg ccgcggtgct gaggggggagg ggagccggcg agcgcgcgcg cagcgggggc
  61 gcgggtggcg cgcgtgtgtg tgaagggggg gcggtggccg aggcgggcgg gcgcgcgcgc
 121 gaggcttccc ctcgtttggc ggcggccgcg gcttcttgt ttcgtgaaga gaagcgagac
 181 gcccattctg cccccggccc cgcgcggagg ggcggggag gcgcgggaa gtcgacggcg
 241 ccggcggctc ctgcgtctcg cccttttgcc caggctagag tgcagtggtg cggtcatggt
 301 tcactgcagc ctcaacctcc tggactcagc aggaggccac tgtctgcagc tcccgtgaag
 361 atgtccactc cagacccacc cctgggcgga actcctcggc caggtcctttc cccgggcccct
 421 ggcccttccc ctggagccat gctgggccct agcccgggtc cctcgccggg ctccgcccac
 481 agcatgatgg ggcccagccc agggccgccc tcagcaggac accccatccc cacccagggg
 541 cctggagggt accctcagga caacatgcac cagatgcaca agcccatgga gtccatgcat
 601 gagaaggca tgtcggacga cccgcgctac aaccagatga aaggaatggg gatgcggtca
 661 ggggggccatg ctgggatggg gccccgccc agccccatgg accagcactc ccaaggttac
 721 ccctcgcccc tgggtggctc cgagcatgcc tctagtccag ttccagccag tggcccgtct
 781 tcgggggccccc agatgtcttc cgggccagga ggtgccccgc tggatggtgc tgacccccag
 841 gccttgggc agcagaaccg gggcccaacc ccatttaacc agaaccagct gcaccagctc
 901 agagctcaga tcatggccta caagatgctg gccagggggc agcccctccc cgaccacctg
 961 cagatggcgg tgcagggcaa gcggccgatg cccgggatgc agcagcagat gccaacgcta
1021 cctccaccct cggtgtccgc aacaggaccc ggcctggcc cggccctgg ccccggcccg
1081 ggtcccggcc cggcacctcc aaattacagc aggcctcagc tgtatggagg gccaacatg
1141 cctccccag gaccctcggg cgtgccccc gggatgccaa gccagcctcc tggagggcct
1201 cccaagcct ggcctgaagg acccatggcg aatgctgctg ccccacgag caccctcag
1261 aagctgattc ccccgcagcc aacgggccgc cttcccccg cgccctgc cgtcccaccc
1321 gccgcctcgc ccgtgatgcc accgacagcc cagtccccg ggcagccggc ccagcccccg
1381 cccatggtgc cactgcacca gaagcagagc cgcatcaccc ccatccagaa gccgcggggc
1441 ctcgaccctg tggagatcct gcaggagcgc gagtacaggc tgcaggctcg catgcgcacac
1501 cgaattcagg aacttgaaaa ccttccccggg tccctggccg gggatttgcg aaccaaagcg
1561 accattgagc tcaagggcct caggctgctg aacttccaga ggcagctgcg ccaggaggtg
1621 gtggtgtgca tgcggagggga cacagccgctg gagacagcc tcaatgctaa ggcctacaaa
1681 cgcagcaagc gccagtccct gcgcgaggcc cgcatcactg agaagctgga gaagcagcag
1741 aagatcgagc aggagcgcaa gcgccggcag aagcaccagg aatacctcaa tagcattctc
1801 cagcatgcca aggatttcaa ggaatatcac agatccgtca caggcaaaaa ccagaagctg
1861 accaaggcag tggccacgta ccatgccaac acggacggg agcagaagaa agagaacgag
1921 cggatcgaga aggagcgcat gcggaggctc atggctgaag atgaggaggg gtaccgcaag
1981 ctcatcgacc agaagaagga caagcgcctg gcctacctct gcagcagac agacgagtac
2041 gtggctaacc tcacggagct ggtgcggcag cacaaggctg cccaggtcgc caaggagaaa
2101 aagaagaaaa agaaaaagaa gaaggcagaa aatgcagaag gacagacgcc tgccattggg
2161 ccggatggcg agcctctgga cgagaccagc cagatgagcg acctcccggt gaaggtgatc
2221 cacgtggaga gtgggaagat cctcacaggc acagatgccc ccaaagccgg gcagctggag
2281 gcctggctcg agatgaaccc ggggtatgaa gtagctccga ggtctgatag tgaagaaagt
2341 ggctcagaag aagaggaaga ggaggaggag gaggagcgc cgcaggccgc acagcctccc
2401 accctgccc tggaggagaa gaagaagatt ccagatccag acagcgatga cgtctctgcc
2461 gtggacgcgc ggcacatcat tgagaatgcc aagcaagatg tcgatgatga atatggcgtg
2521 tcccaggccc ttgcacgtgg cctgcagtcc tactatgccg tgggcccatgc tgtcactgag
2581 agagtggaca gccagtcagc gcttatgtc tcaaacagta ccagatcaaa
2641 ggttggagt ggctggtgtc cctgtacaac aacaacctga acggcatcct ggccgacgag
2701 atgggcctgg gaaagaccat ccagaccatc gcgctcatca cgtacctcat ggagcacaaa
2761 cgcatcaatg ggcccttcct catcatcgtg cctctctcaa cgctgtccaa ctgggcgtac
2821 gagtttgaca agtgggcccc ctccgttgtg aaggtgtctt acaagggatc cccagcagca
2881 agacgggcct ttgtccccca gctccggagt gggaagttca acgtcttgct gacgacgtac
2941 gagtacatca tcaaagacaa gcacatcctc gccaagatcc gttggaagta catgattgtg
3001 gacgaaggtc accgcatgaa gaaccaccac tgcaagctga cgcaggtgct caacacgcac
3061 tatgtgggcac ccgccgcct gctgctgacg ggcacaccgc tgcagaacaa gcttcccgag
3121 ctctgggcgc tgctcaactt cctgctgccc accatcttca agagctgcag caccttcgag
3181 cagtggttta cgcaccctt tgccatgacc ggggaaaagg tggacctgaa tgaggaggaa
3241 accattctca tcatccggcg tctccacaaa gtgctgcggc ccttcttgct ccgacgactc
3301 aagaaggaag tcgaggccca gttgcccgaa aaggtggagt acgtcatcaa gtgcgacatg
3361 tctgcgctgc agcgagtgct ctaccgccac atgcaggcca agggcgtgct gctgactgat
3421 ggctccgaga aggacaagaa gggcaaaggc ggcaccaaga cctgatgaa caccatcatg
3481 cagctgcgga agatctgcaa ccaccctac acgttccagc acatcgagga gtcttttcc
3541 gagcacttgg ggttcactgg cggcattgtc caggggctgg accttgtaccg agcctcgggt
3601 aaatttgagc ttcttgacag aattcttccc aaactccgag caaccaacca caagtgctg
3661 ctgttctgcc aaatgaccct cctcatgacc atcatggaag attactttgc gtatcgcgcc
3721 tttaaatacc tcaggcttga tggaaccacg aaggcggagg accgggggcat gctgctgaaa
3781 accttcaacg agcccggctc tgagtacttc atcttcctgc tcagcacccg ggctgggggg
3841 ctcggcctga acctccagt ggcagacact gtgatcattt tgacagcga ctggaatcct
3901 caccaggacc tgcaagcgca ggaccgagcc caccgcatcg ggcagcagaa cgaggtcgt
3961 gtgctccgcc tctgcaccgt caacagcgtg gaggagaaga tcctagctgc agccaagtac
4021 aagctcaacg tggaccagaa ggtgatccag gccggcatgt tcgaccagaa gtcctccagc
4081 catgagcggc gcgcctttct caggggcatc ctggagcagg aggagcagga tgaggcagga
4141 cactgcagca cgggcagcgg cagtgccagc ttcgcccaca ctgcccctcc gccagcgggc
4201 gtcaacccg acctggagga gcacctcta aaggaggaag acgaggtgcc cgacgacgag
4261 accgtcaacc agatgatcgc ccggcacgag gaggaggttg atctgttcat gcgcatggac
4321 ctgaccgca gccgcgagga ggcccgcaac cccaagcgcg agcgcgcct catggaggag
4381 gacgagctcc cctcgtggat catcaaggac gacgcggagg tggaccgcgt gacctgtgag
4441 gaggaggagg agaagatgtt cggccgtgc tccgccacc gcaaggaggt ggactacagc
4501 gactcactga cggaagcca gtggcctaag gccatcgagg agggcacgct ggaggagatc
4561 gaagaggagg tccgcgcaaa gaaatcatca cggaagcgca gcgagcaga cgacgccggc
4621 tcctccaccc cgaccaccag cacccgcagc cgcgacaagg acgacgagag caagaagcag
```

TABLE 1-continued

```
4681 aagaagcgcg ggcggccgcc tgccgagaaa ctctccccta acccacccaa cctcaccaag
4741 aagatgaaga agattgtgga tgccgtgatc aagtacaagg acagcagcag tggacgtcag
4801 ctcagcgagg tcttcatcca gctgccctcg cgaaaggagc tgcccgagta ctacgagctc
4861 atccgcaagc ccgtggactt caagaagata aaggagcgca ttcgcaacca caagtaccgc
4921 agcctcaacg acctagagaa ggacgtcatg ctcctgtgcc agaacgcaca gaccttcaac
4981 ctggagggct ccctgatcta tgaagactcc atcgtcttgc agtcggtctt caccagcgtg
5041 cggcagaaaa tcgagaagga ggatgacagt gaaggcgagg agagtgagga ggaggaagag
5101 ggcgaggagg aaggctccga atccgaatct cggtccgtca aagtgaagat caagcttggc
5161 cggaaggaga aggcacagga ccggctgaag ggcggccggc ggcggccgag ccgagggtcc
5221 cgagccaagc cggtcgtgag tgacgatgac agtgaggagg aacaagagga ggaccgctca
5281 ggaagtgcga gcgaagaaga ctgagcccccg acattccagt ctcgaccccg agccctcgt
5341 tccagagctg agatggcata ggccttagca gtaacgggta gcagcagatg tagtttcaga
5401 cttggagtaa aactgtataa acaaaagaat cttccatatt tatacagcag aagagctgta
5461 ggactgtttg tgactggccc tgtcctggca tcagtagcat ctgtaacagc attaactgtc
5521 ttaaagagag agagagagaa ttccgaattg gggaacacac gatacctgtt tttctttttcc
5581 gttgctggca gtactgttgc gccgcagttt ggagtcactg tagttaagtg tggatgcatg
5641 tgcgtcaccg tccactcctc ctactgtatt ttattggaca ggtcagactc gccgggggcc
5701 cggcgagggt atgtcagtgt cactggatgt caaacagtaa taaattaaac caacaacaaa
5761 acgcacagcc aaaaaaaaa
```

SEQ ID NO: 56 Human BRG1 Amino Acid Sequence Isoform B (NP_001122316.1)
```
    1 mstpdpplgg tprpgpspgp gpspgamlgp spgpspgsah smmgpspgpp saghpiptqg
   61 pggypqdnmh qmhkpmesmh ekgmsddpry nqmkgmgmrs gghagmgppp spmdqhsqgy
  121 psplggseha sspvpasgps sgpqmssgpg gapldgadpq algqqnrgpt pfnqnqlhql
  181 raqimaykml argqplpdhl qmavqgkrpm pgmqqqmptl pppsvsatgp gpgpgpgpgp
  241 gpgpappnys rphgmggpnm pppgpsgvpp gmpgqppggp kpwpegpma naaaptstpq
  301 klippqptgr pspappavpp aaspvmppqt qspgqpaqpa pmvplhqkqs ritpiqkprg
  361 ldpveilqer eyrlqariah riqelenlpg slagdlrtka tielkalrll nfqrqlrqev
  421 vvcmrrdtal etalnakayk rskrqslrea riteklekqq kieqerkrrq khqeylnsil
  481 qhakdfkeyh rsvtgkiqkl tkavatyhan tereqkkene riekermrrl maedeegyrk
  541 lidqkkdkrl ayllqqtdey vanltelvrq hkaaqvakek kkkkkkkae naegqtpaig
  601 pdgepldets qmsdlpvkvi hvesgkiltg tdapkagqle awlemnpgye vaprsdsees
  661 gseeeeeeee eeqpqaaqpp tlpveekkki pdpdsddvse vdarhiiena kqdvddeygv
  721 sqalarglqs yyavahavte rvdkqsalmv ngvlkqyqik glewlvslyn nnlngilade
  781 mglgktiqti alitylmehk ringpfliiv plstlsnway etdkwapsvv kvsykgspaa
  841 rrafvpqlrs gkfnvlltty eyiikdkhil akirwkymiv deghrmknhh ckltqvlnth
  901 yvaprrlllt gtplqnklpe lwallnfllp tifkscstfe qwfnapfamt gekvdlneee
  961 tiliirrlhk vlrpfllrrl kkeveaqlpe kveyvikcdm salqrvlyrh mqakgvlltd
 1021 gsekdkkgkg gtktlmncim qlrkicnhpy mfqhieessfs ehlgftggiv qgldlyrasg
 1081 kfelldrilp klratnhkvl lfcqmtslmt imedyfayrg fkylrldgtt kaedrgmllk
 1141 tfnepgseyf iflllstragg lglnlqsadt viifdsdwnp hqdlqaqdra hrigqqnevr
 1201 vlrlctvnsv eekilaaaky klnvdqkviq agmfdqksss herraflqai leheeqdesr
 1261 hcstgsgsas fahtapppag vnpdleeppl keedevpdde tvnqmiarhe eefdlfmrmd
 1321 ldrrreearn pkrkprlmee delpswiikd daeverltce eeeekmfgrg srhrkevdys
 1381 dsltekqwlk aieegtleei eeevrqkkss rkrkrdsdag sstpttstrs rdkddeskkq
 1441 kkrgrppaek lspnppnltk kmkkivdavi kykdsssgrq lsevfiqlps rkelpeyyel
 1501 irkpvdfkki kerirnhkyr slndlekdvm llcqnaqtfn legsliyeds ivlqsvftsv
 1561 rqkiekedds egeeseeeee geeegseses rsvkvkiklg rkekaqdrlk ggrrrpsrgs
 1621 rakpvvsddd seeeqeedrs gsgseed
```

SEQ ID NO: 57 Human BRG1 cDNA Sequence Variant 3 (NM_003072.3, CDS: from 285 to 5228)
```
    1 ggagaggccg ccgcggtgct gaggggagg ggagccggcg agcgcgcgcg cagcgggggc
   61 gcgggcggcg cgcgtgtgtg tgaaggggg gcggtggccg aggcgggcgg gcgcgcgcgc
  121 gaggcttccc tcgtttggc ggcggcggcg gcttccttgt ttcgtgaaga gaagcgagac
  181 gcccattctg ccccccgccc cgcgcggagg ggcggggag gcgcgggaa gtcgacgcg
  241 ccggcggctc ctgcaggagg ccactgtctg cagctcccgt gaagatgtcc actccagacc
  301 caccccctggg cggaactcct cggccaggtc cttccccggg ccctggccct tcccctggag
  361 ccatgctggg cctagcccg ggtcccctcgc cgggctccgc ccacagcatg atggggccca
  421 gcccagggcc ccctcagca ggacacccca tcccacccca ggggcctgga gggtacccctc
  481 aggacaacat gcaccagatg cacaagccca tggagtccat gcatgagaag ggcatgtcgg
  541 acgaccccgcg ctacaaccag atgaaaggaa tggggatgcg gtcaggggc catgctggga
  601 tggggccccc gcccagccc atggaccagc actcccaggg ttaccctcg ccctggggtg
  661 gctctgagca tgcctctagc ccagttccag ccagtgggcc gccttcgggg ccccagatgt
  721 cttccggcc aggaggtgcc ccgctggatg gtgctgaccc ccaggcttg ggcagcaga
  781 accggggccc aaccccattt aaccagaacc agctgcacca gctcagagct cagatcatgg
  841 cctacaagat gctggccagg gggcagcccc tccccgacca cctgcagatg gcggtgcagg
  901 gcaagcggcc gatgccgggg atgcagcagc agatgccaac gctacctcca ccctcggtgt
  961 ccgcaacagg acccggccct gggcctggcc ctggcccggg ccgggtcccc ggcccggcac
 1021 ctccaaatta cagcaggcct catggtatgg gagggcccaa catgcctccc ccaggaccct
 1081 cgggcgtgcc ccccggggca ccaggccagc ctcctggagg gcctcccaag tcctggcctg
 1141 aaggaccat ggcgaatgtc gctgccccca cgagcacccc tcagagctg attccccgc
 1201 agccaacggg ccgcccttcc ccgcgcccc ctgccgtccc acccgccgcc tcgcccgtga
 1261 tgccaccgca gacccagtcc cccgggcagc cggccagcc cgcgcccatg gtgccactgc
 1321 accagaagca gagccgcatc acccccatcc agaagccgcg gggctcaggc cctgtggaga
 1381 tcctgcagga gcgctagtac aggctgcagg ctcgcatcgc acaccgaatt caggaacttg
 1441 aaaaccttcc cgggtccctg gccgggattt gcgaaccaa agcgaccatt gagctcaagg
 1501 ccctcaggct gctgaacttc cagaggcagc tgcgccagga ggtggtggtg tgcatgcgga
 1561 gggacacagc gctggagaca gccctcaatg ctaaggccta caagcgcagc aagcgccagt
 1621 ccctgcgcga ggcccgcatc actgagaagc tggagaagca gcagaagatc gagcaggagc
```

TABLE 1-continued

```
1681 gcaagcgccg gcagaagcac caggaatacc tcaatagcat tctccagcat gccaaggatt
1741 tcaaggaata tcacagatcc gtcacaggca aaatccagaa gctgaccaag gcagtggcca
1801 cgtaccatgc caacacggag cgggagcaga agaaagagaa cgagcggatc gagaaggagc
1861 gcatgcggag gctcatggct gaagatgagg aggggtaccg caagctcatc gaccagaaga
1921 aggacaagcg cctggcctac ctcttgcagc agacagacga gtacgtggct aacctcacgg
1981 agctggtgcg gcagcacaag gctgcccagg tcgccaagga gaaaagaag aaaagaaaa
2041 agaagaaggc agaaaatgca gaaggacaga cgcctgccat tgggccggat ggcgagcctc
2101 tggacgagac cagccagatg agcgacctcc cggtgaaggt gatccacgtg gagagtggga
2161 agatcctcac aggcacagat gcccccaaag ccgggcagct ggaggcctgg ctcgagatga
2221 acccggggta tgaagtagct ccgaggtctg atagtgaaga aagtggctca gaagaagagg
2281 aagaggagga ggaggaagag cagccgcagg cagcacagcc tccaccctg cccgtggagg
2341 agaagaagaa gattccagat ccagacagcg atgacgtctc tgaggtggac gcgcggcaca
2401 tcattgagaa tgccaagcaa gatgtcgatg atgaaatatg cgtgtcccag gcccttgcac
2461 gtggcctgca gtcctactat gccgtggccc atgctgtcac tgagagagtg gacaagcagt
2521 cagcgcttat ggtcaatggt gtcctcaaac agtaccagat caaaggtttg gagtggctgg
2581 tgtccctgta caacaacaac ctgaacggca tcctggccga cgagatgggc ctggggaaga
2641 ccatccagac catcgcgctc atcacgtacc tcatggagca caaacgcatc aatgggccct
2701 tcctcatcat cgtgcctctc tcaacgctgt ccaactgggc gtacgagttt gacaagtggg
2761 cccctccgt ggtgaaggtg tcttacaagg atccccagc agcaagacgg gcctttgtcc
2821 cccagctccg gagtgggaag ttcaacgtct tgctgacgac gtacgagtac atcatcaaag
2881 acaagcacat ccctcgccaag atccgttgga agtacatgat tgtggacgaa ggtcaccgca
2941 tgaagaacca ccactgcaag ctgacgcagg tgctcaacac gcactatgtg gcaccccgcc
3001 gcctgctgct gacgggcaca ccgctgcaga acaagcttcc cgagctctgg gcgctgctca
3061 acttcctgct gcccaccatc ttcaagagct gcagcacctt cgagcagtgg tttaacgcac
3121 cctttgccat gaccggggga aaggtggacc tgaatgagga ggaaaccatt ctcatcatcc
3181 ggcgtctcca caaagtgctg cggcccttct tgctccgacg actcaagaag gaagtcgagg
3241 cccagttgcc cgaaaaggtg gagtacgtca tcaagtgcga catgtccgcg ctgcagcgag
3301 tgctctaccg ccacatgcag gccaagggcg tgctgctgac tgatggctcc gagaaggaca
3361 agaagggcaa aggcggcacc aagaccctga tgaacaccat catgcagctg cggaagatct
3421 gcaaccaccc ctacatgttc cagcacatcg aggagtcctt ttccgagcac tggggttca
3481 ctggcggcat tgtccaaggg ctggacctgt accgagcctc gggtaaattt gagcttcttg
3541 atagaattct tcccaaactc cgagcaacca accacaaagt gctgctgttc tgccaaatga
3601 cctccctcat gaccatcatg gaagattact ttgcgtatcg cggctttaaa tacctcaggc
3661 ttgatggaac cacgaaggcg gaggaccggg gcatgctgct gaaaaccttc aacgagcccg
3721 gctctgagta cttcatcttc ctgctcagca cccgggctgg ggggctcggc ctgaacctcc
3781 agtcggcaga cactgtgatc atttttgaca gcgactgaa tcctccaccag gacctgcaag
3841 cgcaggaccg agcccaccgc atcgggcagc agaacaggt gcgtgcgctc cgcctctgca
3901 ccgtcaacag cgtggaggag aagatcctag tgcagccaa gtacaagctc aacgtggacc
3961 agaaggtgat ccaggccggc atgttcgacc agaagtcctc cagccatgag cggcgcgcct
4021 tcctgcaggc catcctggag cacgaggagc aggatgagag cagacactgc agcacgggca
4081 gcggcagtgc cagcttcgcc cacactgccc ctcgccagc gggcgtcaac cccgacttgg
4141 aggagccacc tctaaaggag gaagacgagg tgcccgacga cgagaccgtc aaccagattg
4201 tcgcccggca cgaggaggac tttgatctgt tcatgcgcat ggacctggac cgcaggcgcg
4261 aggaggcccg caacccccaag cggaagccgc gcctcatgga ggaggacgag ctcccctcgt
4321 ggatcatcaa ggacgacgcg gaggtggagc ggctgacctg tgaggaggag gaggagaaga
4381 tgttccggcg tggctcccgc caccgcaagg aggtggacta cagcgactca ctgacggaga
4441 agcagtggct caaggccatc gaggagggca cgctggagga gatcgaagag gaggtccggc
4501 agaagaaatc atcacggaag cgcaagcgag acagcgacgc cggctcctcc acccgacca
4561 ccagcacccg cagccgcgac aaggacgacg agagcaagaa gcagaagaag cgcgggcggc
4621 cgcctgccga gaaactctcc cctaacccac caacctcac caagaagacg aagaagattg
4681 tggatgccgt gatcaagtac aaggacagca gcagtggacg tcagctcagc gaggtcttca
4741 tccagctgcc ctcgcgaaag gagctgcccg agtactacga gctcatccgc aagcccgtgg
4801 acttcaagaa gataaaggag cgcattcgca accacaagta ccgcagcctc aacgacctag
4861 agaaggacgt catgctcctg tgccagaacg cacagacctt caacctggag ggctccctga
4921 tctatgaaga ctccatcgtc ttgcagtcgg tcttccaccag cgtgcggcag aaaatcgaga
4981 aggaggatga cagtgaaggc gaggagagtg aggaggagga agaaggggag gaggaaggct
5041 ccgaatccga atctcggtcc gtcaaagtga agatcaagct tggccggaag gagaaggcac
5101 aggaccggct gaagggcggc cggcggcggc cgagccgagg tcccgagcc aagccggtcg
5161 tgagtgacga tgacagtgag gaggaacaag aggaggaccg ctcaggaagt gacagcgaag
5221 aagactgagc cccgacattc cagtctcgac cccgagcccc tcgttccaga gctgagatgg
5281 cataggcctt agcagtaacg ggtagcagca gatgtagttt cagacttgga gtaaaactgt
5341 ataaacaaaa gaatcttcca tatttataca gcagagaagc tgtaggactg tttgtgactg
5401 gccctgtcct ggcatcagta gcatctgtaa cagcattaac tgtcttaaag agagagagag
5461 agaattccga attggggaac acacgatacc tgttttttctt ttccgttgct ggcagtactg
5521 ttgcgccgca gtttggagtc actgtagtta agtgtggatg catgtgcgtc accgtccact
5581 cctcctactg tactttattg gacaggtcag actcgccggg ggccggcga gggtatgtca
5641 gtgtcactgg atgtcaaaca gtaataaact aaaccaacaa caaaacgcac agccaaaaaa
5701 aaa
```

SEQ ID NO: 58 Human BRG1 cDNA Sequence Variant 4 (NM_001128845.1, CDS: from 1 to 4854)

```
  1 atgtccactc cagacccacc cctgggcgga actcctcggc caggtccttc cccgggccct
 61 ggcccttccc ctggagccat gctgggccct agccggtc cctcgcggg ctccgccac
121 agcatgatgg ggcccagccc agggccgccc tcagcaggac accccatccc cacccagggg
181 cctggagggt accctcagga caacatgcac agatgcgcaca agccatgga gtccatgcat
241 gagaagggca tgccggacga cccgcgctac aaccagatga aggaatgggg gatgcggtca
301 gggggccatg ctgggatggg gccccgccc agccccatgg accagcactc caaggttac
361 ccctcgcccc tgggtggctc tgagcatgcc tctagtccag tcccagccag tggcccgtct
421 tcgggggccc agatgtcttc cgggccagga ggtgcccgc tggatggtgt gaccccag
481 gccttggggc agcagaaccg ggcccaacc ccatttaacc agaaccagct gcaccagctc
```

TABLE 1-continued

```
 541 agagctcaga tcatggccta caagatgctg gccaggggc agcccctccc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcacctcc aaattacagc aggcctcatg gtatgggagg gcccaacatg
 781 cctcccccag gaccctcggg cgtgcccccc gggatgccag gccagcctcc tggagggcct
 841 cccaagccct ggcctgaagg acccatggcg aatgctgctg ccccacgag caccctcag
 901 aagctgattc ccccgcagcc aacgggccgc ccttccccg cgcccctgc cgtcccaccc
 961 gccgcctcgc ccgtgatgca accgcagacc cagtccccg ggcagcggc ccagcccgcg
1021 cccatggtgc cactgcacca gaagcagag cgcatcaccc ccatccagaa gccgcggggc
1081 ctcgaccctg tggagatcct gcaggagcgc gagtacaggc tgcaggctcg catcgcacac
1141 cgaattcagg aacttgaaaa ccttcccggg tccctggccg gggatttgcg aaccaaagcg
1201 accattgagc tcaaggccct caggctgctg aacttccaga ggcagctgcg ccaggaggtg
1261 gtggtgtgca tgcggaggga cacagcgctg gagacagcc tcaatgctaa ggctacaag
1321 cgcagcaagc gccagtcccc gcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaaga agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag gacagacgcc tgccattggg
1801 ccggatgcg agcctctgca cgagaccagc cagatgagcg accccccggt gaaggtgatc
1861 cacgtggaga gtgggaagat cctcacaggc acagatgccc caaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca agcagtcagc gcttatggtc aatggtgtcc tcaaacagta ccagatcaaa
2281 ggtttggagt ggctggtgtc cctgtacaac aacaacctga acggcatcct ggccgacgag
2341 atgggcctgg ggaagaccat ccagaccatc gcgctcatca cgtacctcat ggagcacaaa
2401 cgcatcaatg ggcccttcct catcatcgtg cctctctcaa cgctgtccaa ctgggcgtac
2461 gagtttgaca gtgggcccc ctccgtggtg aaggtgtctt acaagggatc cccagcagca
2521 agacgggcct ttgtccccca gctccggagt gggaagttca acgtcttgct gacgacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gctgctgacg ggcacaccgc tgcagaacaa gcttcccgag
2761 ctctgggcgc tgctcaactt cctgctgccc accatcttca agagctgcag caccttcgag
2821 cagtggttta acgcaccctt tgccatgacc ggggaaaagg tggacctgaa tgaggaggaa
2881 accattctca tcatccggcg tctccacaaa gtgctgcggc ccttcttgct ccgacgactc
2941 aagaaggaag tcgaggccca gttgccgaa aaggtggagt acgtcatcaa gtgcgacatg
3001 tctgcgctgc agcgagtgct ctaccgccac atgcaggcca agggcgtgct gctgactgac
3061 ggctccgaga aggacaagaa gggcaaaggc ggcaccaaga ccctgatgaa caccatcatg
3121 cagctgcgga agatctgcaa ccaccctac atgttccagc acatcgagga gtcctttcc
3181 gagcacttgg ggttcactgg cggcattgtc caagggctgg acctgtaccg agcctcgggt
3241 aaatttgagc ttctcgatag aattcttccc aaactccgga caaccaacca caaagtgctg
3301 ctgttctgcc aaatgacctc cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagtacttc atcttcctgc tcagcacccg ggctgggggg
3481 ctcggcctga acctccagtc ggcagacact gtgatcattt ttgacagcga ctggaatcct
3541 caccaggacc tgcaagcgca ggaccgagcc caccgcatcg ggcagcagaa cgaggtgcgt
3601 gtgctccgcc tctgcaccgt caacagcgtg gaggagaaga tcctagctgc agccaagtac
3661 aagctcaacg tggaccagaa ggtgatccag gccggcatgt tcgaccagaa gtcctccagc
3721 catgagcggc gcgccttcct gcaggccatc ctggagcagg aggagcagga tgaggaggaa
3781 gacgaggtgc ccgacgacga gaccgtcaac cagatgatcg cccgaccga gggaggagttt
3841 gatctgttca tgcgcatgga cctggaccgc aggcgcgagg aggcccgcaa ccccaagcgg
3901 aagccgcgcc tcatggagga ggacgagctc ccctcgtgga tcatcaagga cgacgcggag
3961 gtggagcggc tgacctgtga ggaggaggag gagaagatgt tcggccgtgg ctcccgccac
4021 cgcaaggagg tggactacag cgactcactg acggaggagc agtggctcaa gacccgaaga
4081 gccatcgagg agggcacgct ggaggagatc aagaggagg tccggcagaa gaaatcatca
4141 cggaagcgca agcgagacag cgacgccggc tcctccaccc cgaccaccag cacccgcagc
4201 cgcgacaagg acgacgagag caagaagcag aagaagcgcg gcggccgcc tgccgagaaa
4261 ctctcccca acccaccaa cctcaccaag aagatgaaga agattgtgga tgccgtgatc
4321 aagtacaagg acagcagcag tggacgtcag ctcagcgagg tcttcatcca gctgcctcg
4381 cgaaaggagc tgcccgagta ctacgagctc atccgcaagc cgtggactt caagaagata
4441 aaggagcgca ttcgcaacca caagtaccgc agcctcaacg acctagagaa ggacgtcatg
4501 ctcctgtgcc agaacgcaca gaccttcaac ctggagggct ccctgatcta tgaagactcc
4561 atcgtcttgc agtcggtctt caccagcgtg cggcagaaaa tcgagaagga ggatgacagt
4621 gaaggcgagg agagtgagga ggaggaagag ggcgaggagg aaggctccga atccgaatct
4681 cggtccgtca aagtgaagat caagcttggc cggaaggaga aggcacagga ccggctgaag
4741 ggcggccggc ggcggccgga ccgagggtcc cgagccaagc cggtcgtgag tgacgatgac
4801 agtgaggagg aacaagagga ggaccgctca ggaagtggca gcgaagaaga ctgagccccg
4861 acattccagt cccgaccccg agccctcgt tccagagctg agatggcata ggccttagca
4921 gtaacgggta gcagcagatg tagtttcaga cttggagtaa aactgtataa acaaaagaat
4981 cttccatatt tatacagcag agaagctgta ggactgtttg tgactgcc ttcctggca
5041 tcagtagcat ctgtaacagc attaactgtc ttaaagagag agagagagaga ttccgaattg
5101 gggaacacac gatacctgtt tttctttcc gttgctggca gtactgttgc gccgcagttt
5161 ggagtcactg tagttaagtg tggatgcatg tgcgtcaccg tccactcctc ctactgtatt
5221 ttattggaca ggtcagactc gccgggggcc cggcgagggt acgtcagtgt cactggatgt
5281 caaacagtaa taaattaaac caacaacaaa acgcacagcc aaaaaaaaa
```

TABLE 1-continued

SEQ ID NO: 59 Human BRG1 Amino Acid Sequence Isoform C (NP_001122317.1)
```
    1 mstpdpplgg tprpgpspgp gpspgamlgp spgpspgsah smmgpspgpp saghpiptqg
   61 pggypqdnmh qmhkpmesmh ekgmsddpry nqmkgmgmrs gghagmgppp spmdqhsqgy
  121 psplggseha sspvpasgps sgpqmssgpg gapldgadpq algqqnrgpt pfnqnqlhql
  181 raqimaykml argqpldhl qmavqgkrpm pgmqqqmptl pppsvsatgp gpgpgpgpgp
  241 gpgpappnys rphgmggpnm pppgpsgvpp gmpgqppggp pkpwpegpma naaaptstpq
  301 klippqptgr pspappavpp aaspvmppqt qspgqpaqpa pmvplhqkqs ritpiqkprg
  361 ldpveilqer eyrlqariah riqelenlpg slagdlrcka tielkalrll nfqrqlrqev
  421 vvcmrrdtal etalnakayk rskrqslrea riteklekqq kieqerkrrq khqeylnsil
  481 qhakdfkeyh rsvtgkiqkl tkavatyhan tereqkkene riekermrrl maedeegyrk
  541 lidqkkdkrl ayllqqtdey vanltelvrq hkaaqvakek kkkkkkkkae naegqtpaig
  601 pdgepldets qmsdlpvkvi hvesgkiltg tdapkagqle awlemnpgye vaprsdsees
  661 gseeeeeeee eeqpqaaqpp tlpveekkki pdpdsddvse vdarhiiena kqdvddeygv
  721 sqalarglqs yyavahavte rvdkqsalmv ngvlkqyqik glewlvslyn nnlngilade
  781 mglgktiqti alitylmehk ringpfliiv plstlsnway efdkwapsvv kvsykgspaa
  841 rrafvpqlrs gkfnvlltty eyiikdkhil akirwkymiv deghrmknhh ckltqvlnth
  901 yvaprrlllt gtplqnklpe lwallnfllp tifkscstfe qwfnapfamt gekvdlneee
  961 tiliirrlhk vlrpfllrrl kkeveaqlpe kveyvikcdm salqrvlyrh mqakgvlltd
 1021 gsekdkkgkg gtktlmntim qlrkicnhpy mfqhieesfs ehlgftggiv qgldlyrasg
 1081 kfelldrilp klratnhkvl lfcqmtslmt imedyfayrg fkylrldgtt kaedrgmllk
 1141 tfnepgseyf ifllstragg lglnlqsadt viifdsdwnp hqdlqaqdra hrigqqnevr
 1201 vlrlctvnsv eekilaaaky klnvdqkviq agmfdqksss herraflqai leheeqdeee
 1261 devpddetvn qmiarheeef dlfmrmdldr rreearnpkr kprlmeedel pswiikddae
 1321 verltceeee ekmfgrgsrh rkevdysdsl tekqwlktlk aieegtleei eeevrqkkss
 1381 rkrkrdsdag sstpttstrs rdkddeskkq kkrgrppaek lspnppnltk kmkkivdavi
 1441 kykdssgrq lsevfiqlps rkelpeyyel irkpvdfkki kerirnhkyr slndlekdvm
 1501 llcqnaqtfn legsliyeds ivlqsvftsv rqkiekedds egeeseeeee geeegseses
 1561 rsvkvkiklg rkekaqdrlk ggrrrpsrgs rakpvvsddd seeeqeedrs gsgseed
```

SEQ ID NO: 60 Human BRG1 cDNA Sequence Variant 5 (NM_001128846.1, CDS: From 1 to 4851)
```
    1 atgtccactc cagacccacc cctgggcgga actcctcggc caggtccttc cccgggccct
   61 ggcccttccc ctggagccat gctgggccct agcccgggtc cctcgcccgg ctccgcccac
  121 agcatgatgg ggcccagccc agggccgccc tcagcaggac accccatccc cacccagggg
  181 cctggagggt accctcagga caacatgcac cagatgcaca agcccatgga gtccatgcat
  241 gagaagggca tgtcggacga cccgcgctac aaccagatga aggaatggg gatgcggtca
  301 ggggccatg ctgggatggg gccccgcccc agcccgctcg accactc ccaaggttac
  361 ccctcgcccc tgggtggctc tgagcatgcc tctagtccag ttccagccag tggcccgtct
  421 tcggggcccc agatgtcttc cggccagga ggtgccccgc tggatggtgc tgacccccag
  481 gccttggggc agcagaaccg ggcccaacc ccatttaacc agaaccagct gcaccagctc
  541 agagctcaga tcatggccta caagatgctg gcaggggga gcccctccc cgaccacctg
  601 cagatggcgg tgcaggcaa gcggccgatg cccgggatgc agcagcagat gccaacgcta
  661 cctccacct cggtgtccgc aacaggaccc ggccctggcc ctggccctgg cccgggcccg
  721 ggtcccgcc cggcaccctc aaattacagc aggcctcatg gtatgggagg cccaacatg
  781 cctccccag gacccctcgg cgtgccccc tggatgccag gccagcctcc tggagggcct
  841 cccaagcct ggcctgaagg acccatggcg aatgctgctg ccccacgag cacccctcag
  901 aagctgattc ccccgcagcc aacgggccgc ccttcccccg cgcccCgc cgtcccaccc
  961 gccgcctcgc ccgtgatgcc accgcagacc cagtcccccg ggcagccggc ccagcccgcg
 1021 cccatggtgc cactgcacca gaagcagagc cgcatcaccc ccatccagaa gccgcggggg
 1081 ctcgaccctg tggagatcct gcaggagcgc gagtacaggc tgcaggctcg catcgcacac
 1141 cgaattcagg aacttgaaaa ccttcccggg tccctggccg ggatttgcg aaccaaagcg
 1201 accattgagc tcaaggccct caggctgctg aacttccaga ggcagctgcg ccaggaggtg
 1261 gtggtgtgca tgcgaaggga cacagcctg gagacagcc tcaatgctaa ggcctacaag
 1321 cgcagcaagc gccagtccct cgcgagggcc cgcatcactg agaagctgga gaagcagcag
 1381 aagatcgagc aggagcgcaa gcgccggcag aagcaccagg aatacctcaa tagcattctc
 1441 cagcatgcca aggattcaa ggaatatcac agatccgtca caggcaaat ccagaagctg
 1501 accaaggcag tggccacgta ccatgccaac acggagcggg agcagaagaa agagaacgag
 1561 cggatcgaga aggagcgcat gcggaggctc atggctgaag atgaggaggg gtaccgcaag
 1621 ctcactgacc agaagaagga caagcccg cctacctct tgcagcagac agacgagtac
 1681 gtggctaacc tcacggagct ggtgcggcag cacaaggctg cccaggtcgc caaggagaaa
 1741 aagaagaaaa agaaaaagaa gaaggcagaa atgcagaag acagacgcc tgccattggg
 1801 ccggatgcg agcctctgg cgagaccagc cagatgatg acctcccgt gaaggtgatc
 1861 cacgtggaga gtgggaagat cctcacaggc acagatgccc ccaaagccgg gcagctggaa
 1921 gcctggctcg agatgaaccc gggtatgaa gtagctccga ggtctgatag tgaagaagt
 1981 ggctcagaag aagaggaaga ggaggaggag gaaagagcagc cgcaggcagc acagcctccc
 2041 accctgcccg tggaggaaga gaaagaaatt ccagatccaga acagcgatga cgtctctgag
 2101 gtggacgcgc ggcacatcat tgaaatgcc aagcaagatg tcgatgatga atatggcgtg
 2161 tcccaggccc ttgcacgctg cctgcagtcc tactacgccg tggcccatgc tgtcactgag
 2221 agagtggaca gcagtcagc gcttatggtc aatggtgtcc tcaaacagta ccagatcaaa
 2281 ggtttggagt ggctggtgtc cctgtacaac aacaacctga acggcatcct ggccgacgag
 2341 atgggcctgg ggaagaccat ccagaccatc gcgctcatca cgtacctcat ggagcacaaa
 2401 cgcatcaatg ggcccttcct catcatcgtg cctctctcaa cgctgtccaa ctgggcgtac
 2461 gagtttgaca gtgggcccc ctccgtggtg aaggtgtctt acaagggatc cccagcagca
 2521 agaccggct tcgtccccca gctccgcagt ggaagttca acgtcttgct gacgacgtag
 2581 gagtacatca tcaaagacaa gcacatcctc gccaagatcc gttggaagta catgattgtg
 2641 gacgaaggtc accgcatgaa gaaccaccac tgcaagctga cgcaggtgct caacacgcac
 2701 tatgtggcac ccgccgcct gctgctgacg ggcacaccgc tgcagaacaa gcttcccgag
 2761 ctctgggcgc tgctcaactt cctgctgccc accatcttca gagctgcag caccttcgag
 2821 cagtggttta acgcaccctt tgccatgacc ggggaaaagg tggacctgaa tgaggagaa
```

TABLE 1-continued

```
2881 accattctca tcatccggcg tctccacaaa gtgctgcggc ccttcttgct ccgacgactc
2941 aagaaggaag tcgaggccca gttgcccgaa aaggtggagt acgtcaccaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccaccoctac atgttccagc acatcgagga gtccttttcc
3181 gagcacttgg ggttcactgg cggcattgtc caagggctgg acctgtaccg agcctcgggt
3241 aaatttgagc ttcttgatag aattcttccc aaactccgag caaccaacca caaagtgctg
3301 ccgttctgcc aaatgaccte cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagcacttc atctccctgc tcagcacccg ggctggggg
3481 ctcggcctga acctccagtc ggcagacact gtgatcattt ttgacagcga ctggaatcct
3541 caccaggacc tgcaagcgca ggaccgagcc caccgcatcg ggcagcagaa cgaggtgcgt
3601 gtgctccgcc tctgcacccgt caacagcgtg gaggagaaga tcctagctgc agccaagtac
3661 aagctcaacg tggaccagaa ggtgatccag gccgacatgt tcgaccagaa gtcctccagc
3721 catgagcggc gcgccttcct gcaggccatc ctgagcacg aggagcagga tgaggaggaa
3781 gacgaggtgc ccgacgacga gaccgtcaac cagatgatcg cccggcacga ggaggagttt
3841 gatctgttca tgcgcatgga cctgaccgc aggcgcggag aggcccgcaa cccaagcgg
3901 aagccgcgcc tcatggagga ggacgagctc ccctcgtgga tcatcaagga cgacgcggag
3961 gtggagcggc tgacctgtga ggaggaggag gagaagatgt tcggccgtgg ctcccgccac
4021 cgcaaggagg tggactacag cgactcactg acggagaagc agtggcccaa gaccctgaag
4081 gccatcgagg agggcacgct ggaggagatc gaagaggagg tccggcagga gaaatcatca
4141 cggaagcgca agcgagacag cgacgccggc tcctccaccc cgaccaccag cacccgcagc
4201 cgcgacaagg acgacgagag caagaagcag aagaagcgcg ggcggccgcc tgccgagaaa
4261 ctctccccta acccacccaa cctcaccaag aagatgaaga agattgtgga tgccgtgatc
4321 aagtacaagg acagcagtga acgtcagctc agcgaggtct tcatccagct gccctcgcga
4381 aaggagctgc ccgagtacta cgagctcatc cgcaagcccg tggacttcaa gaagataaag
4441 gagcgcattc gcaaccacaa gtaccgcagc ctcaacgacc tagaagga cgtcatgctc
4501 ctgtgccaga acgcacagac cttcaacctg gagggctccc tgatctatga agactccatc
4561 gtcttgcagt cggtcttcac cagcgtgcgg cagaaaatcg agaaggagga tgacagtgaa
4621 ggcgaggaga gtgaggagga ggaagagggc gaggaggaag gctccgaatc cgaatctcgg
4681 tccgtcaaag tgaagatcaa gcttggccgg aaggagaagg cacaggaccg gctgaagggc
4741 ggccggcggc ggccgagccg agggtcccga gccaagccgg tcgtgagtga cgatgacagt
4801 gaggaggaac aagaggagga ccgctcagga agtggcagcg aagaagactg agccccgaca
4861 ttccagtctc gaccccgacc ccctcgttcc agagctgaga tggcataggc cttagcagta
4921 acgggtagca gcagatgtag tttcagactt ggagtaaaac tgtataaaca aaagaatctt
4981 ccatatttat acagcagaga agctgtagga ctgtttgtga ctggccctgt cctggcatca
5041 gcagcatctg taacagcatt aactgtctta aagagagaga gagagaattc cgaattgggg
5101 aacacacgat acctgttttt cttttccgtt gctggcagta ctgttgcgcc gcagtttgga
5161 gtcactgtag ttaagtgtgg atgcatgtgc gtcaccgtcc actcctccta ctgtattta
5221 ttggacaggt cagactcgcc gggggcccgg cgagggtatg tcagtgtcac tggatgtcaa
5281 acagtaataa attaaaccaa caacaaaacg cacagccaaa aaaaaa
```

SEQ ID NO: 61 Human BRG1 Amino Acid Sequence Isoform D (NP_001122318.1)
```
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 raqimaykml argqplpdhl qmavqgkrpm pgmqqqmptl pppsvsatgp gpgpgpgpgp
 241 gpgpappnys rphgmggpnm pppgpsgvpp gmpgqppggp pkpwpegpma naaaptstpq
 301 klippqptgr pspappavpp aaspvmppqt qspgqpaqpa pmvplhqkqs ritpiqkprg
 361 ldpveilqer eyrlqariah riqelenlpg slagdlrtka tielkalrll nfqrqlrqev
 421 vvcmrrdtal etalnakayk rskrqslrea ritekekekqq kieqerkrrq khqeylnsil
 481 qhakdfkeyh rsvtgkiqkl tkavatyhan tereqkkene riekermrrl maedeegyrk
 541 lidqkkdkrl ayllqqtdey vanltelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpqaaqpp tlpveekkki pdpdsddvse vdarhiiena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvlnch
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl ltcqmtslmt imedytayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlktlk aieegtleei eeevrqkkss
1381 rkrkrdsdag sstpttstrs rdkddeskkq kkrgrppaek lspnppnltk kmkkivdavn
1441 kykdssgrql sevfiqlpsr kelpeyyeli rkpvdfkkik erirnhkyrs lndlekdvml
1501 lcqnaqtfnl egsliyedsi vlqsvftsvr qkiekeddse geeseeeeeg eeegsesesr
1561 svkvkiklgr kekaqdrlkg grrrpsrgsr akpvvsddds eeeqeedrsg sgseed
```

SEQ ID NO: 62 Human BRG1 cDNA Sequence Variant 6 (NM_001128847.1, CDS: from 1 to 4845)
```
   1 atgtccactc cagacccacc cctgggcgga actcctcggc caggtccttc ccgggccct
  61 ggcccttcc ctggagccat gctgggccct agcccgggtc cctcgccggg ctccgcccac
 121 agcatgatgg ggcccagccc agggccgccc tcagcggac acccccatcc caccaggg
 181 cctggagggt accctcagga caacatgcac cagatgcaca agcccatgga gtccatgcat
 241 gagaagggca tgtcggacga cccgcgctac aaccagatga aggaatggg gatgcggtca
 301 ggggggccatg ctgggatggg gccccgccc agcccatgg accagcactc caaggttac
 361 ccctcgcccc tgggtggctc tgagcatgcc tctagtccag tcccagccag tggccccgtct
```

TABLE 1-continued

```
 421 tcggggcccc agatgtcttc cgggccagga ggtgccccgc tggatggtgc tgaccccag
 481 gccttggggc agcagaaccg gggcccaacc ccatttaacc agaaccagct gcaccagctc
 541 agagctcaga tcatggccta caagatgctg gccaggggc agccctccc cgaccacctg
 601 cagatggcgg tgcagggcaa gcggccgatg cccgggatgc agcagcagat gccaacgcta
 661 cctccaccct cggtgtccgc aacaggaccc ggccctgcc ctgccctgg ccccggcccg
 721 ggtcccggcc cggcacctcc aaattacagc aggcctcatg gtatgggagg gcccaacatg
 781 cctcccccag gaccctcggg cgtgcccccc gggatgccaa gccagcctcc tggagggcct
 841 cccaagcct ggcctgaagg acccatggcg aatgctgctg cccccacgag caccctcag
 901 aagctgattc cccgcagcc aacgggccgc ccttccccg cgcccctgc cgtcccaccc
 961 gccgcctcgc ccgtgatgcc accgcagacc cagtccccg ggcagccggc ccagcccgcg
1021 cccatggtgc cactgcacca gaagcagagc cgcatcaccc ccatccagaa gccgcggggc
1081 ctcgaccctg tggagatcct gcaggagcgc gagtacaggc tgcaggctcg catcgcacac
1141 cgaattcagg aacttgaaaa ccttcccggg tccctggccg gggatttgcg aaccaaagcg
1201 accattgagc tcaaggcct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag gcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcaagaa agagaacgag
1561 cggatcgaga aggagcgcat cggaggctc atggctgaag atgaggaggg gtaccgcaag
1621 ctcatcgacc agaagaagga caagccgctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag gacagacgcc tgccattggg
1801 ccggatgcg agcctctgga cgagaccagc cagatgagcg acctcccggt gaaggtgatc
1861 cacgtggaga gtgggaagat cctcacaggc acagatgccc ccaaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagact ccagatccag acagcgatga cgtctctgag
2101 gtggacgcgc ggcacatcat tgaaatgcc aacaagatg tcgatgatga atatgccgtg
2161 tcccaggccc ttgcacgtgg cctgcagtcc tactatgcc tggcccatgc tgtcactgag
2221 agagtggaca agcagtcagc gcttatggtc aatggtgtcc tcaaacagta ccagatcaaa
2281 ggtttggagt ggctggtgtc cctgtacaac aacaacctga acggcatcct ggccgacgag
2341 atgggcctgg ggaagaccat ccagaccatc gcgctcatca cgtacctcat ggagcacaaa
2401 cgcatcaatg ggcccttcct catcatcgtg cctctctcaa cgctgtccaa ctgggcgtac
2461 gagttttgaca agtgggcccc ctccgtggtg aaggtgtctt acaagggatc cccagcagca
2521 agacgggcct tgtcccccca gctccggagt gggaagttca acgtcttgct gacgacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gccgctgacg ggcacaccgc tgcagaacaa gcttcccgag
2761 ctctgggcgc tgctcaactt cctgctgccc accatcttca agagctgcag caccttcgag
2821 cagtggtttta acgcacccct tgccatgacc ggggaaaagg tggacctgaa tgaggaggaa
2881 accattctca tcatccggcg tctccacaaa gtgctgcggc ccttcctgct ccgacgactc
2941 aagaaggaag tcgaggccca gttgcccgaa aaggtggagt acgtcatcaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccacccctac atgttccagc acatcgagga gtcctttttcc
3181 gagcacttgg ggttcactgg cggcattgtc caagggctgg acctgtaccg agcctcgggt
3241 aaatttgagc ttcttgatag aattcttccc aaactccgag caaccaacca caaagtgctg
3301 ctgttctgcc aaatgacctc cctcatgacc atcatggaag attacttttgc gtatcgcggc
3361 tttaaatacc tcaggcttga tggaaccacg aaggcggaag accggggcat gctgctgaaa
3421 accttcaacg agcccggctc tgagtacttc atcttcctgc tcagcacccg ggctgggggg
3481 ctcggcctga acctccagtc ggcagacact gtgatcattt ttgacagcga ctggaatcct
3541 caccaggacc tgcaagcgca ggaccgagcc caccgcatcg ggcagcagaa cgaggtgcgt
3601 gtgctccgcc tctgcaccgt caacagccgtg gaggagaaga tcctagctgc agccaagtac
3661 aagctcaacg tggaccagaa ggtgatccag gccggcatgt tcgaccagaa gtcctccagc
3721 catgagcggc gcgccttcct gcaggccatc ctggagcacg aggacagga tgaggaggaa
3781 gacgaggtgc ccgacgacga ccgtcaac cagatgatcg cccggcacga ggaggagttt
3841 gatctgttca tgcgcatgga cctggaccgc aggcgcgagg aggcccgcaa ccccaagcgg
3901 aagccgcgcc tcatggagga ggacgagctc ccctcgttga tcatcaagga cgacgcggag
3961 gtggagcggc tgacctgtga ggaggaggag gagaagatgt tcggccgtgg ctcccgccac
4021 cgcaaggagg tggactacag cgactcaccg acggagaagc agtggctcaa ggccatcgag
4081 gagggcacgc tggaggagat cgaagaggag gtccggcaga gaaaatcatc acggaagcgc
4141 aagcgagaca gcgacgccgg ctcctccacc ccgaccacca gcacccgcag ccgcgacaag
4201 gacgacgaga gcaagaagca gaagaagcgc gggcggccgc ctgccgagaa actctcccct
4261 aaacccaccca acctcaccaa gaagatgaag aagattgtgg atgccgtgat caagtacaag
4321 gacagcagca gtggacgtca gctcagcgag gtcttcaccc agctgccctc gcgaaaggag
4381 ctgcccgagt actacgagct catccgcaag cccgtgtgact tcaagaagat aaaggagcgc
4441 attcgcaacc acaagtaccg cagcctcaac gacctagaga aggacgtcat gctcctgtgc
4501 cagaacgcac agaccttcaa cctggagggc tccctgatct atgaagactc catcgtcttg
4561 cagtcggtct tcaccagcgt gcggcagaaa atcgagaagg aggatgacag tgaaggcgag
4621 gagagtgagg aggaggaaga gggcgaggag gaaggctccg aatccgaatc tcggtccgtc
4681 aaagtgaaga tcaagcttgg ccggaaggag aaggcacaga accggctgaa gggcggccgg
4741 cggcggccga gccgagggtc ccgagccaag ccggtcgtga gtgacgatga cagtgaggag
4801 gaacaagagg aggaccgctc aggaagtggc agcgaagaag actgagcccc gcattccag
4861 tctcgacccc gagcccctcg ttccagagct gagatggcat aggccttagc agtaacgggt
4921 agcagcagat gtagtttcag acttggagta aaactgtata aacaaaagaa tcttccatat
4981 ttatacagca gagaagctgt aggactgttt gtgactggcc ctgtcctggc atcagtagca
5041 tctgtaacag cattaactgt cttaaagaga gagagagaga attccgaatt ggggaacaca
5101 cgatacctgt tttctttttc cgttgctggc agtactgttg cgccgcagtt tggagtcact
5161 gtagttaagt gtggatgcat gtgcgtcacc gtccactcct cctactgtat tttattggac
```

| TABLE 1-continued |

```
5221 aggtcagact cgccggggc ccggcagggg tatgtcagtg tcactggatg tcaaacagta
5281 ataaattaaa ccaacaacaa aacgcacagc caaaaaaaaa SEQ ID NO: 63 Human BRG1 Amino Acid Sequence Isoform E (NP_001122319.1)
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 raqimaykml argqplpdhl qmavqgkrpm pgmqqqmptl pppsvsatgp gpgpgpgpgp
 241 gpgpappnys rphgmggpnm pppgpsgvpp gmpgqppggp pkpwpegpma naaaptstpq
 301 klippqptgr pspappavpp aaspvmppqt qspgqpaqpa pmvplhqkqs ritpiqkprg
 361 ldpveilqer eyrlqariah riqelenlpg slagdlrtka tielkalrll nfqrqlrqev
 421 vvcmrrdtal etalnakayk rskrqslrea ritekleqq kieqerkrrq khqeylnsil
 481 qhakdfkeyh rsvtgkiqkl tkavatyhan tereqkkene riekermrrl maedeegyrk
 541 lidqkkdkrl ayllqqtdey vanltelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpaaaqpp tlpveekkki pdpdsddvse vdarhiieena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rratvpqlrs gkfnvlltty eyiikdkhil akitwkymiv deghrmknhh ckltqvlnth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mtqhieeesfs ehlgftggiv qgldlyrasg
1081 kfelldrilp klratnhkvl lfcqmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdsdagsst pttstrsrdk ddeskkqkkr grppaeklsp nppnltkkmk kivdavikyk
1441 dsssgrqlse vfiqlpsrke lpeyyelirk pvdfkkiker irnhkyrsln dlekdvmllc
1501 qnaqtfnleg sliyedsivl qsvftsvrqk iekeddsege eseeeeegee egsesesrsv
1561 kvkiklgrke kaqdrlkggr rrpsrgsrak pvvsdddsee eqeedrsgsg seed SEQ ID NO: 64 Human BRG1 cDNA Sequence Variant 7 (NM_001128848.1, CDS:
from 1 to 4842)
   1 atgtccactc cagacccacc cctgggcgga actcctcggc caggtccttc cccgggccct
  61 ggccctttcc ctggagccat gctgggccct agcccgggtc cctcgcgggg ctccgcccac
 121 agcatgatgg ggcccagccc agggccgccc tcagcaggac accccatccc cacccagggg
 181 cctggagggt accctcagga caacatgcac cagatgcaca agccatgga gtccatgcat
 241 gagaagggca tgtcggacga cccgcgctac aaccagatga aggaatggg gatgcggtca
 301 gggggccatg ctgggatggg gcccccgccc agccccatgg accagcactc ccaaggttac
 361 ccctcgcccc tgggtggctc tgagcatgcc tctagtccaa ttccagccag tggcccgtct
 421 tcggggcccc agatgtcttc cgggccagga ggtgccccgc tggatggtgc tgaccccag
 481 gccttggggc agcagaaccg ggcccaacc ccatttaacc agaaccagct gcaccagctc
 541 agagctcaga tcatggccta caagatgctg gccaggggc agccccctcc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcaccccc aaaattacagc aggcctcatg gcatgggagg gcccaacatg
 781 cctccccag gaccctcggg cgtgcccccc gggatgccag gccagcctcc tggagggcct
 841 cccaagccct ggcctgaagg acccatggcg aatgctgctg ccccacgag caccctcag
 901 aagctgattc ccccgcagcc aaacgggcgc ccttccccg cgccccctgc cgtcccacc
 961 gccgcctcgc ccgtgatgcc accgcagacc cagtcccccg ggcagccggc ccagcccgcg
1021 cccatggtgc cactgcacca gaagcagagc cgcatcaccc ccatccagaa gccgcggggc
1081 ctcgaccctg tggagatcct gcaggagcgc gagtacaggc tgcaggctcg catcgcacac
1141 cgaattcagg aacttgaaa ccttcccggg tccctggccg gggatttgcg aaccaaaagcg
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag aagcaccagg aatacctcaa cagcattctc
1441 cagcatgcca aggatttcaa ggaatatcac agatccgtca caggcaaaat ccagaagctg
1501 accaaggcag tggccacgca ccatgccaac acggagcggg agcagaagaa agagaacgtg
1561 cggatcgaga aggagcgcat gcggaggctc atggctgaag atgaggaggg gtaccgcaag
1621 ctcatcgacc agaagaagga caagcgcctg gcctaccttc tgcagcagac agacgagtac
1681 gtggctaacc tcacggagct ggtgcggcag cacaaggctg cccaggtcgc caaggagaaa
1741 aagaagaaaa agaaaaagaa gaaggcagaa aacgcagaag gacagacgcc tgccattggg
1801 ccggatgcgg agcctctgga cgagaccagc cagatgagcg acctcccggt gaaggtgatc
1861 cacgtggaga gtgggaagat cctcacaggc acagatgccc caaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa aagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca agcagtcagc gcttatggtc aatggtgtcc tcaaacagta ccagatcaaa
2281 ggtttggagt ggctggtgtc cctgtacaac aacacctga acggcatcct ggccgacgag
2341 atgggcctgg ggaagaccat ccagaccatc gcgctcatca cgtacctcat ggagcacaaa
2401 cgcatcaatg ggccttcct catcatcgtg cctctctcaa cgctgtccaa ctgggcgtac
2461 gagttttgaca agtgggcccc ctccgtggtg aagggtgtctt acaagggatc cccagcagca
2521 agacgggcct ttgtcccca gctccggagt gggagttca acgtcttgct gacacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gctgctgacg ggcacaccgc tgcagaacaa gcttcccgag
```

TABLE 1-continued

```
2761 ctctgggcgc tgctcaactc cctgctgccc accatcttca agagctgcag caccttcgag
2821 cagtggttta acgcacccct tgccatgacc ggggaaaagg tggacctgaa tgaggaggaa
2881 accattctca tcatccggcg tctccacaaa gtgctgcggc ccttcttgct ccgacgactc
2941 aagaaggaag tcgaggccca gttgcccgaa aaggtggagt acgtcatcaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccaccctac atgttccagc acatcgagga gtccttttcc
3181 gagcacttgg ggttcactgg cggcattgtc caagggctgg acctgtaccg agcctcgggt
3241 aaatttgagc ttcttgacag aattcttccc aaactccgag caaccaacca caaagtgctg
3301 ctgttctgcc aaatgacctc cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagtacttc atcttcctgc tcagcacccg ggctgggggg
3481 ctcggcctga acctccagtc ggcagacact gcgatcattt tcgacagcga ctggaatcct
3541 caccaggacc tgcaagcgca ggaccgagcc caccgcatcg ggcagcagaa cgaggtgcgt
3601 gtgctccgcc tctgcaccgt caacagcgtg gaggagaaga tcctagctgc agccaagtac
3661 aagctcaacg tggaccagaa ggtgatccag gccggcatgt tcgaccagaa gtcctccagc
3721 catgagcggc gcgccttcct gcaggccatc ctggaagcca ggagcagga tgaggaggaa
3781 gacgaggtgc ccgacgacga gaccgtcaac cagatgatcg cccggcacga ggaggagttt
3841 gatctgttca tgcgcatgga cctggaccgc aggcgcgagg aggcccgcaa ccccaagcgg
3901 aagccgcgcc tcatggagga ggacgagctc ccctcgtgga tcatcaagga cgacgcggag
3961 gtggagcggc tgacctgtga ggaggaggag agaaagatgt tcggccgtgg ctcccgccac
4021 cgcaaggagg tggactacag cgactcactg acggagaagc agtggctcaa ggccatcgag
4081 gagggcacgc tggaggagat cgaagaggag gtccggcaga agaaatcatc acggaagcgc
4141 aagcgagaca gcgacgccgg ctcctccacc ccgaccacca gcacccgcag ccgcgacaag
4201 gacgacgaga gcaagaagca gaaaagcgc gggcggccgc ctgccgagaa actctcccct
4261 aacccaccca acctccaccaa gaagatgaag aagattgtgg atgccgtgat caagtacaag
4321 gacagcagtg gacgtcagct cagcgaggtc ttcatccagc tgccctcgcg aaaggagctg
4381 cccgagtact acgagctcat ccgcaagccc gtggacttca gaagataaa ggagcgcatt
4441 cgcaaccaca agtaccgcag cctcaacgac ctagagaagg acgtcatgct cctgtgccag
4501 aacgcacaga ccttcaacct ggagggctcc ctgatctatg aagactccat cgtcttgcag
4561 tcggtcttca ccagcgtgcg gcagaaaatc gagaaggagg atgacagtga aggcgaggag
4621 agtgaggagg aggaagaggg cgaggaggaa ggctccgaat ccgaatctcg gtccgtcaaa
4681 gtgaagatca agcttggccg gaaggagaag gcacaggacc ggctgaaggg cggccggcgg
4741 cggccgagcc gagggtcccg agccaagccg gtcgtgagtg acgatgacag tggaggaggaa
4801 caagaggagg accgctcagg aagtggcagc gaagaagact gagccccgac attccagtct
4861 cgaccccgag cccctcgttc cagagctgag atggcatagg ccttagcagt aacgggtagc
4921 agcagatgta gtttcagact tggagtaaaa ctgtataaac aaaagaatct tccatattta
4981 tacagcagag aagctgtagg actgttttgtg actggccctg tcccggcatc agtagcatct
5041 gtaacagcat taactgtctt aaagagagag agagagaatt ccgaattggg gaacacacga
5101 tacctgtttt tcttttccgt tgctggcagc actgttgcgc cgcagtttgg agtcactgta
5161 gttaagtgtg gatgcatgtg cgtcaccgtc cactcctcct actgtatttt attggacagg
5221 tcagactcgc cgggggcccg gcgagggtat gtcagcgtca ctggatgtca aacagtaata
5281 aattaaacca acaacaaaac gcacagccaa aaaaaaa
```

SEQ ID NO: 65 Human BRG1 Amino Acid Sequence Isoform F (NP_001122320.1)
```
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 raqimaykml argqplpdhl qmavqgkrpm pgmqqqmptl pppsvsatgp gpgpgpgpgp
 241 gpgpappnys rphgmggpnm pppgpsgvpp gmpgqppgpp pkpwpegpma naaapcstpq
 301 klippqptgr pspappavpp aaspvmppqt qspgqpaqpa pmvplhqkqs ritpiqkprg
 361 ldpveilqer eyrlqariah riqelenlpg slagdlrtka tielkalrll nfqrqlrqev
 421 vvcmrrdtal etalnakayk rskrqslrea riteklekqq kieqerkrrq khqeylnsil
 481 qhakdfkeyh rsvtgkiqkl tkavatyhan tereqkkene riekermrrl maedeegyrk
 541 lidqkkdkrl ayllqqtdey vanltelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpqaaqpp tlpveekkki pdpdsddvse vdarhiiena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwpsvv kvsykgspaa
 841 rrafvpqlrs gkfnvlltty eyiikdkhil akirwkymiv deghrmknhh ckltqvlnth
 901 yvaprrlllt gtplqnklpe lwallnfllp tifkscstfe qwfnapfamt gekvdlneee
 961 tiliirrlhk vlrpfllrrl kkeveaqlpe kveyvikcdn salqrvlyrh mqakgvlltd
1021 gsekdkkgkg grktlmntim qlrkicnhpy mfqhieesfs ehlgftggiv qglldlyrasg
1081 kfelldrilp klratnhkvl lfcqmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikdlae
1321 verltceeee ekmfgrgsrh rkevdysdsl tekqwlkale egtleeieee vrqkkssrkr
1381 krdsdagsst pttstrsrdk ddeskkqkkr grppaeklsp nppnltkkmk kivdavikyk
1441 dssgrqlsev fiqlpsrkel peyyelirkp vdfkkikeri rnhkyrslnd lekdvmlleq
1501 naqtfnlegs liyedsivlq svftsvrqki ekeddsegee seeeeegeee gsesesrsvk
1561 vkiklgrkek aqdrlkggrr rpsrgsrakp vvsdddseee qeedrsgsgs eed
```

SEQ ID NO: 66 Mouse BRG1 cDNA Sequence Variant 1 (NM_001174078.1, CDS: from 261 to 5114)
```
   1 ggcaagtgga gcgggtagac agggaggcgg gggcgcgcgg cgggcgcgtg cggtggggggg
  61 gggtggcctg gcgaagccca gcgggcgcgc gcgcgaggct ttcccactcg cttggcagcg
 121 gcggagacgc ttctttgtt tcctgaggag aagcgagacg cccactctgt ccccgacccc
 181 tcgtggaggg ttgggggcgg cgccaggaag gttacggcgc cgttacctcc aggagaccag
 241 tgcctgtagc tccagtaaag atgtctactc cagacccacc cttgggtggg actcctcggc
```

TABLE 1-continued

```
 301 ctggtccttc cccaggccct ggtccttcac ctggtgcaat gctgggtcct agccctggcc
 361 cctcaccagg ttctgcccac agcatgatgg ggccaagccc aggacctcct tcagcaggac
 421 atcccatgcc cacccagggg cctggagggt accccagga caacatgcat cagatgcaca
 481 agcctatgga gtccatgcac gagaagggca tgcctgatga cccacgtac aaccagatga
 541 aagggatggg catgcggtca ggggcccaca caggcatggc acctccacct agtcccatgg
 601 accagcattc tcaaggttac ccctcacccc tcggcggctc tgaacatgcc tccagtcctg
 661 tcccagccag tggcccatct tcaggccccc agatgtcctc tgggccagga ggggccccac
 721 tagatggttc tgatcccag gccttgggac agcaaaacag aggcccaacc ccatttaacc
 781 agaaccagct gcatcaactc agagctcaga taatggccta caagatgttg gccagggcc
 841 agccattgcc cgaccacctg cagatggccg tgcaaggcaa gcggccgatg cctggaatgc
 901 agcaacagat gccaacacta cctccaccct cagtgtccgc cacaggaccc ggacctggac
 961 ccggccctgg ccctggccct ggccaggac cagcccctcc aaattacagt agaccccatg
1021 gtatgggagg gcccaacatg cccccccag gaccctcagg tgtgcccccc gggatgcctg
1081 gtcagccgcc tggagggcct cccaagccat ggcctgaagg acccatggcc aatgctgctg
1141 cccccacaag cacccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gcggtgtgca tgcgaagaga cacagccctg gagacagcc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctggaa gcctggcttg aaatgaaccc agggtatgaa gtagccccca
2221 ggtcagacag tgaagaaagt ggctctgaag aggaggagga ggaggaggaa gaggagcagc
2281 ctcagcccgc acagccccct acactgcctg tggaagaaaa gaagaagatt ccagacccag
2341 acagcgatga tgtctctgag gtggacgccc gacacattat tgaacgcc aagcaagatg
2401 tggacgatga gtacggtgtg tcccaggccc ttgctcgtgg cctgcagtct tactatgctg
2461 tggcccatgc agtcacagag agagtagata agcagtccgc cctcatggtc aacggtgtcc
2521 tcaaacagta ccagatcaag ggttttggagt gctggtgtc cctgtacaac aacaacctga
2581 atggcatcct ggctgatgag atgggctgg ggaagaccat ccagaccatc gcgctcatca
2641 catacctcat ggagcacaag cgcatcaacg ggcctttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgccccaca gcttcgcagt gggaagttca
2821 acgtcttact gaccaccat gaatatatca tcaaagacaa gcatatccta gccaagatcc
2881 gctggaagta catgattgtg gatgaaggcc accgcatgaa aaaccaccac tgcaagttga
2941 cgcaggtcct taacacacac tacgtggccc ctcggcgcct gcttcttaca ggcacaccac
3001 tgcagaacaa gctaccggag ctctgggccc tgcttaactt cctgctcccc actatcttca
3061 agagctgcag caccttcgaa cagtggttca atgcacccct tgccatgact ggagaaaagg
3121 tggacctgaa tgaagaggag actatcctca ttattcgtcg cctacacaaa gttctgcggc
3181 ccttcctgct gcggcggctc aagaaggaag ttgaagccca gctccctgag aaggtagagt
3241 atgtcatcaa atgcgacatg tcagccctgc agcgtgtgct gtaccgtcac atgcaggcca
3301 aaggtgtgct gctgactgac ggctccgaga aggacaagaa gggcaaaggt ggcaccaaga
3361 cactgatgaa cactattatg caactgcgta agatctgcaa ccaccccac atgttccagc
3421 acatcgagga gtcctttttct gagcacttgg ggttcaccgg cggcatcgtg caaggattgg
3481 accttttaccg tgcctcaggg aaatttgaac ttcttgacag aattctaccc aaactccgtg
3541 caacgaacca taaagtgctc ctcttttgcc aaatgaccte cctcatgacc atcatgaag
3601 actactttgc ataccgtggc ttcaaatacc tcaggcttga tggaaccaca aaagcagaag
3661 accggggcat gctgttgaaa acctttaatg aacctggctc tgagcatttc attttcctgc
3721 tcagtaccg tgctgggggg ctgggcctga atctgcagtc agctgacact gtgatcatct
3781 ttgacagtga ctggaatccc caccaggacc tgcaagcaca ggatcgagcc catcgcattg
3841 gacagcagaa tgaggtgcgt gttcttcgcc tgtgcacggt caacagtgtg aagagaaga
3901 tactggctgc tgccaaatac aaactcaatg tggatcagaa ggtgatccag gcaggcatgt
3961 tcgaccagaa gtcgtccagc catgagaggc gtgccttcct gcaggccatc ctggagcacg
4021 aggagcagga tgaggaggaa gatgaggtgc ctgatgatga gaccgtcaac cagatgattg
4081 cccggcacga agaagagttt gacctcttca tgcgcatgga cttggaccgc cggcgtgaag
4141 aagcccgcaa ccccaagcgg aagccacgcc tgatggaaga ggatgagctc ccatcctgga
4201 tcatcaagga tgatgccgag gtggagcggc tgacatgtga agaggaagag agaagatgt
4261 tcggccgtgg tcctcgccac cgcaaggagg tagactacag cgacccctc acagagaagc
4321 agtggctcaa gaccctgaag gctatcgagg agggcacgct ggaggagatc gaaggaggag
4381 tccggcagaa gaaatcttca cgtaagcgta agcgagacag cgaggccggc tcctccaccc
4441 cgaccaccag cacccgcagc cgtgacaagg atgaggagag caagaagcag aagaaacgtg
4501 ggcggccacc tgctgagaag ctgtccccaa acccacctaa cctcaccaag aagatgaaga
4561 agatcgtgga tgctgtgatc aagtacaaag acagcagcag tggacgtcag ctcagcgagg
4621 tgttcatcca gctcccctct cgcaaggagc ttcctgagta ctatgagctc atccgaaagc
4681 ctgtggactt caagaagatc aaggaacgca tccgaaacca caagtaccgc agcctcaatg
4741 accttgagaa ggatgtgatg ctgctgtgcc agaacgtca gacgttcaac ctcgagggtt
4801 ccctgatcta tgaggactcc atcgtcctgc agtctgtctt caccagcgta cggcagaga
4861 ttgagaagga ggacgacagt gaaggcgagg aaagcgagga ggaggagga ggcgaggagg
4921 aaggctccga gtctgagtcc cgctccgtca aggtgaagat caagctgggc gcaaggagga
4981 aggcccagga ccgactcaag ggggcgcc gcggccaag ccggggatcc cgggccaagc
5041 cggttgtgag tgacgatgac agtgaggagg agcaggagga ggaccgctca ggaagtggca
```

TABLE 1-continued

```
5101 gtgaggaaga ctgaaccaga cattcctgag tcctgacccc gaggcgctcg tcccagccaa
5161 gatggagtag cccttagcag tgatgggtag caccagatgt agtttcgaac ttggagaact
5221 gtacacatgc aatcttccac atttttaggc agagaagtat aggcctgtct gtcggccctg
5281 gcctggcctc gagtctctac cagcattaac tgtctagaga ggggacctcc tgggagcaac
5341 atccacctcc ccaggcccca gtcactgtag ctcagtggat gcatgcgcgt gccggccgct
5401 ccttgtactg taccttactg gacagggcca gctctccagg aggctcacag gcccagcggg
5461 tatgtcagtg tcactggagt cagacagtaa taaattaaag caatgacaag ccaccactgg
5521 ctccctggac tccttgctgt cagcagtggc tccggggcca cagagaagaa agaaagacct
5581 ttaggaactg ggtctaactt atgggcaaag tacttgcctt gccaggtgta tgggttttgc
5641 attcccatca cccacacacc ctaaacaagc caagtgcagtg agcttcaagt tagagcctcc
5701 acctcaatgt gtacgtggaa agcaatcaaa gatgatgcct agcatccacc tctggccctc
5761 atgtgcagat gtacacacac tgaattacat acgggaca cacacatcca cacggaggca
5821 gtccatgact tgcactgggg agatggtacc ataggcgaaa gtgccacagg cacagggcca
5881 ggctaattta gtcctgcagt cctgtgctct taagatgaag gcacaaagag gaaccccagg
5941 cgctccaact agcatgccag gcagtgacaa gaccctgctt caaatgaatc agagcccaca
6001 ttcagtattg ccctcttacc cgatgcgatg cccatgccct cacatatgaa tgcgtatata
6061 tacatacata cgtaaaataa ttctttttta aattatagac attttttgtgt gaatgttttg
6121 cctgaatgtg tgtgtgtgtg tgtgtgtgtg tgtgtgtgtg tgtgtgtgtg tatcaagtac
6181 attcctgagg cctacagagg tcagggagg gcattggatc tggaactgga gtcacatgag
6241 gctgtgagca actgcgtggg ttcctgggcc tttgcaacag cagttagtac tcttcaccac
6301 tgagccattt ctccaatctc aaaaagaagc attcttttaa atgaagactg aaataaataa
6361 gtaggacttg ccctg
```

SEQ ID NO: 67 Mouse BRG1 Amino Acid Sequence Isoform A (NP_001167549.1)

```
   1 mstpdppllgg tprpgpspgp gpspgamlgp spgpspgsah smmgpspgpp saghpmptqg
  61 pggypqdnmh qmhkpmesmh ekgmpddpry nqmkgmgmrs gahtgmappp spmdqhsqgy
 121 psplggseha sspvpasgps sgpqmssgpg gapldgsdpq algqqnrgpt pfnqnqlhql
 181 raqimaykml argqplpdhl qmavqgkrpm pgmqqqmptl pppsvsatgp gpgpgpgpgp
 241 gpgpappnys rphgmggpnm pppgpsgvpp gmpgqppggp pkpwpegpma naaaptstpq
 301 klippqptgr pspappavpp aaspvmppqt qspgqpaqpa plvplhqkqs ritpiqkprg
 361 ldpveilqer eyrlqariah riqeienlpg slagdlrtka tielkalrll nfqrqlrqev
 421 vvcmrrdtal etalnakayk tskrqslrea riteklekqq kieqerkrrq khqeylnsil
 481 qhakdfreyh rsvtgklqkl tkavatyhan tereqkkene riekermrrl maedeegyrk
 541 lidqkkdkrl ayllqqtdey vanltelvrq hkaaqvakek kkkkkkkae naegqtpaig
 601 pdgepldets qmsdlpvkvi hvesgkiltg tdapkagqle awlemnpgye vaprsdsees
 661 gseeeeeeee eeqpqpaqpp tlpveekkki pdpdsddvse vdarhiiena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rralvpqlrs gkfnvlltty eyiikdkhil akirwkymiv deghrmknhh ckltqvlnth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcqmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlktlk aieegtleei eeevrqkkss
1381 rkrkrdseag sstpttstrs rdkdeeskkq kkrgrppaek lspnppnltk kmkkivdavi
1441 kykdsssgrq lsevfiqlps rkelpeyyel irkpvdfkki kerirnhkyr slndlekdvm
1501 llcqnaqtfn legsliyeds ivlqsvftsv rqkiekedds egeeseeeee geeegseses
1561 rsvkvkiklg rkekaqdrlk ggrrrpsrgs rakpvvsddd seeeqeedrs gsgseed
```

SEQ ID NO: 68 Mouse BRG1 cDNA Sequence Variant 2 (NM_011417.3, CDS: from 261 to 5105)

```
   1 ggcaagtgga gcgggtagac agggaggcgg gggcgcgcgg cgggcgcgtg cggtgggggg
  61 gggtggcctg gcgaagccca gcgggcgcgc gcgcgaggct ttcccactcg cttggcagcg
 121 gcggagacgg cttctttgtt tcctgaggag aagcgagacg cccactctgt ccccgacccc
 181 tcgtggaggg ttgggggcgg cgccaggaag gttacggcgc cgttacctcc aggagaccag
 241 tgcctgtagc tccagtaaag atgtctactc cagacccacc cttgggtggg actcctcggc
 301 ctggcccttc cccaggccct ggtccttcac ctggtgcaat gctgggtcct agccctggcc
 361 cctcaccagg ttctgcccac agcatgatgg gccaagccc aggacctcct tcagcaggac
 421 atcccatgcc cacccagggg cctggagggt accccagga caacatgcat cagatgcaca
 481 agcctatgga gtccatgcac gagaagggca tgcctgatga cccacgatac aaccagatga
 541 aagggatggg catgcggtca ggggcccaca caggcatggc acctccacct agtcccatgg
 601 accagcattc tcaaggttac ccctcacccc tcggcggctc tgaacatgcc tccagtcctg
 661 tcccagccag tggcccatct tcaggccccc agatgtcctc tgggccagga ggggcccac
 721 tagatggttc tgatccccag gccttgggac agcaaaacag aggccaatcc ccatttaacc
 781 agaaccagct gcatcaactc agagctcaga taatggccta caagatgttg gccaggggcc
 841 agccattgcc cgaccacctg cagatggccg tgcaaggcaa gcggccgatg cctggaatgc
 901 agcaacagat gccaacacta cctccacccct cagtgtccgc acaggaccc ggacctggac
 961 ccggccctgg ccctggccct ggcccaggac cagccctcc aaattacagt cgacccatg
1021 gtatgggagg gcccaacatg cctcccccag gaccctcagg tgtgcccccc gggatgcctg
1081 gtcagccgcc tggagggcct cccaagccat ggcctgaagg acccatggcc aatgctgctg
1141 cccccacaag caccccacag aagctgatcc ctccgcaacc aacaggccgt ccttcacctg
1201 cacctcctgc tgtccccgcct ctgcctcac ctgtaatgcc accaaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 ggaccttcg aaccaaagca accatcgaac tcaaggccct taggttgctg aacttccaga
1501 ggcagctgcg ccaggaggtg gtggtgtgca tgcgaagaga cacagcccg gagacagccc
```

TABLE 1-continued

```
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctggaa gcctggcttg aaatgaaccc agggtatgaa gtagccccca
2221 ggtcagacag tgaagaaagt ggctctgaag aggaggagga ggaggaggaa gaggagcagc
2281 ctcagcccgc acagcccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata gcagtccgcc cctcatggtc aacggtgtcc
2521 tcaaacagta ccagatcaag ggtttggagt ggctggtgtc cctgtacaac aacaacctga
2581 atggcatcct ggctgatgag atggggctgg ggaagaccat ccagaccatc gcgctcatca
2641 catacctcat ggagcacaag cgcatcaacg ggcctttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgtcccaca gcttcgcagt gggaagttca
2821 acgtcttact gaccacctat gaatatatca tcaaagacaa gcatatccta gccaagatcc
2881 gctggaagta catgattgtg gatgaaggcc accgcatgaa aaaccaccac tgcaagttga
2941 cgcaggtcct taacacacac tacgtggccc ctcggcgcct gcttcttaca ggcacaccac
3001 tgcagaacaa gctaccggag ctctgggccc tgcttaactt cctgctcccc actatcttca
3061 agagctgcag caccttcgaa cagtggttca atgcacccct tgccatgact ggagaaaagg
3121 tggacctgaa tgaagaggag actatcctca ttattcgtcg cctacacaaa gttctgcggc
3181 ccttcctgct gcggcggctc aagaaggaag ttgaagccca gctccctgag aaggtagagt
3241 atgtcatcaa atgcgacatg tcagccctgc agcgtgtgct gtaccgtcac atgcaggcca
3301 aaggtgtgct gctgactgac ggctccgaga aggacaagaa gggcaaggt ggcaccaaga
3361 cactgatgaa cactattatg caactgcgta agatctgcaa ccacccctac atgttccagc
3421 acatcgagga gtccttttct gagcacttgg ggttcaccgg cggcatcgtc caaggattgg
3481 accttttaccg tgcctcaggg aaatttgaac ttcttgatag aattctaccc aaactccgtg
3541 caacgaacca taaagtgctc ctcttttgcc aaatgacctc cctcatgacc atcatggaag
3601 actactttgc ataccgtggc ttcaaatacc tcaggcttga tggaaccaca aaagcagaag
3661 accggggcat gctgttgaaa acctttaatg aacctggctc tgagtatttc attttcctgc
3721 tcagtaccccg tgctgggggg ctgggcctga atctgcagt agctgacact gtgatcatct
3781 ttgacagtga ctggaatccc caccaggacc tgcaagcaca ggatcgagcc catcgcattg
3841 gacagcagaa tgaggtgcgt gttcttcgcc tgtgcacggt caacagtgtg gaagagaaga
3901 tactggctgc tgccaaatac aaaactcaatg tggatcagaa ggtgatccag gcaggcatgt
3961 tcgaccagaa gtcgtccagc catgagaggc gtgccttcct gcaggccatc ctggagcacg
4021 aggagcagga tgaggaggaa gatgaggtgc tcgatgatga gaccgtcaac cagatgattg
4081 cccggcacga agaagagttt gacctcttca tgcgcatgga cttggaccgc cggcgtgaag
4141 aagcccgcaa ccccaagcgg aagccacgcc tgatggaaga ggatgagctc ccatcctgga
4201 tcatcaagga tgatgccgag gtggagcggc tgacatgtga agaggaagag gagaagatgt
4261 tcggccgtgg ttctcgccac cgcaaggagg tagactacag cgactcactg acagagaagc
4321 agtggctcaa ggctatcgag gagggcacgc tggaggagt cgaagaggag gtccggcaga
4381 agaaatcttc acgtaagcgt aagcgagaca gcgaggccgg ctcctccacc ccgaccacca
4441 gcacccgcag ccgtgacaag gatgaggaga gcaagaagca gaagaaacgt gggcggccac
4501 ctgctgagaa gctgtcccca aacccaccta acctcaccaa gaagatgaag aagatcgtgg
4561 atgctgtgat caagtacaaa gacagcagca gtggacgtca gctcagcgag gtgttcatcc
4621 agctcccctc tcgcaaggag cttcctgagt actatgagct catccgaaag cctgtggact
4681 tcaagaagat caaggaaccg atccgaaacc acaagtaccg cagcctcaat gacctggaga
4741 aggatgtgat gctgctgtgc cagaacgctc agacgttcaa cctcgagggt tccctgatct
4801 atgaggactc catcgtcctg cagtctgtct tcaccagcgt acggcagaca attgagaagg
4861 aggacgacag tgaaggcgag gaaagcgagg aggaggagga gggcgaggag gaaggctccg
4921 agtctgagtc ccgctccgtc aaggtgaaga tcaagctggg ccgcaaggag aaggcccagg
4981 accgactcaa gggggggcgc cggcggccaa gccgggatc ccgggccaag ccggttgtga
5041 gtgacgatga cagtgaggag gagcaggagg aggaccgctc aggaagtggc agtgaggaag
5101 actgaaccag acattcctga gtcctgaccc cgaggcgctc gtcccagcca agatggagta
5161 gcccttagca gtgatgggta gcaccagatg tagtttcgaa cttggagaac tgtacacatg
5221 caatcttcca catttttagg cagagaagta taggcctgtc tgtcggccct ggcctggcct
5281 cgagtctcta ccagcattaa ctgtctagag aggggacctc ctgggacac catccacctc
5341 cccaggcccc agtcactgta gctcagtgga tgcatgcgcg tgcggccgc tccttgtact
5401 gtatcttact ggacagggcc agctctccag gaggctcaca ggcccagcgg gtatgtcagt
5461 gtcactggag tcagacagta taaaattaaa gcaatgacaa gccaccactg gctccctgga
5521 ctccttgctg tcagcagtgg ctccggggcc acagagaaga agaaagact tttaggaact
5581 gggtctaact tatgggcaaa gtacttgcct tgccaggtgt atgggttttg cattcccatc
5641 acccacacac cctaaacaag ccaagtcagt gagcttcaag ttagagcctc cacctcaatg
5701 tgtacgtgga aagcaatcaa agatgatgcc tagcatccac ctctggccct catgtgcaga
5761 tgtacacaca ctgaattaca tacacgggac acacacatcc acacggaggc agtccatgac
5821 ttgcactggg gagatggtac cataggcgaa agtgccacag gcacagggcc aggctaattt
5881 agtcctgcag tcctgtgctc ttaagatgaa ggcacaaaga ggaaccccag cgctccaac
5941 tagcatgcca ggcagtgaca agaccctgct tcaaatgaat cagagccac attcagtatt
6001 gccctcttac ccgatgcgat gcccatgccc tcatatatga atgtgtatat atacatacat
```

TABLE 1-continued

```
6061 acgtaaaata attcttttt aaattatatga cattttgtg tgaatgtttt gcctgaatgt
6121 gtgtgtgtgt gtgtgtgtgt gtgtgtgtgt gtgtgtgtgt gtatcaagta cattcctaga
6181 gcctacagag gtcaagggag ggcattggat ctggaactgg agtcacatga ggctgtgagc
6241 aactgtgtgg gttcctgggc ctttgcaaca gcagttagta ctcttcacca ctgagccatt
6301 tctccaatct caaaaagaag cattcttta aatgaagact gaaataaata agtaggactt
6361 gccttgg
```

SEQ ID NO: 69 Mouse BRG1 Amino Acid Sequence Isoform B (NP_035547.2)

```
   1 mstpdpplgg tprpgpspgp gpspgamlgp spgpspgsah smmgpspgpp saghpmptqg
  61 pggypqdnmh qmhkpmesmh ekgmpddpry nqmkgmgmrs gahtgmappp spmdqhsqgy
 121 psplggseha sspvpasgps sgpqmssgpg gapldgsdpq algqqnrgpt pfnqnqlhql
 181 raqimaykml argqplpdhl qmavqgkrpm pgmqqqmptl pppsvsatgp gpgpgpgpgp
 241 gpgpappnys rphgmggpnm pppgpsgvpp gmpgqppggp pkpwpegpma naaaptstpq
 301 klippqptgr pspappavpp aaspvmppqt qspgqpaqpa plvplhqkqs ritpiqkprg
 361 ldpveilqer eyrlqariah riqelenlpg slagdlrtka tielkalrll nfqrqlrqev
 421 vvcmrrdtal etalnakayk rskrqslrea riteklekqq kieqerkrrq khqeylnsil
 481 qhakdfreyh rsvtgklqkl tkavatyhan tereqkkene riekermrrl maedeegyrk
 541 lidqkkdkrl ayllqqtdey vanltelvrq hkaaqvakek kkkkkkkae naegqtpaig
 601 pdgepldets qmsdlpvkvi hvesgkiltg tdapkagqle awlemnpgye vaprsdsees
 661 gseeeeeeee eeqpqpaqpp tlpveekkki pdpdsddvse vdarhiiena kqdvddeygv
 721 sqalarglqs yyavahavte rvdkqsalmv ngvlkqyqdi glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvlnth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcqmtslmt imedyfayrg fkylrldgtt kaedrgmllk
1141 tfnepgseyf iflllstragg lglnlqsadt viifdsdwnp hqdlqaqdra hriggqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdseagsst pttstsrsrdk deeskkqkkr grppaeklsp npplntkkmk kivdavikyk
1441 dsssgrqlse vfiqlpsrke lpeyyelirk pvdfkkiker irnhkyrsln dlekdvmllc
1501 qnaqtfnleg sliyedsivl qsvftsvrqk iekeddsege eseeeeegee egsesesrsv
1561 kvkiklgrke kaqdrlkggr rrpsrgsrak pvvsddddsee eqeedrsgsg seed
```

SEQ ID NO: 70 Mouse BRG1 cDNA Sequence Variant 3 (NM_001174079.1, CDS: from 261 to 5102)

```
   1 ggcaagtgga gcgggtagac agggaggcgg gggcgcgcgg cgggcgcgtg cggtgggggg
  61 gggtggcctg gcgaagccca gcgggcgcgc gcgcgaggct tcccactcg cttggcagcg
 121 gcggagacgg cttctttgtt tcctgaggag aagcgagacg cccactctgt ccccgacccc
 181 tcgtggaggg ttggggggcgg cgcaggaagg gttacgcgcc cgttacctcc aggagaccag
 241 tgcctgtagc tccagtaaag atgtctactc cagacccacc cttgggtggg actcctcggc
 301 ctggtccttc ccagggccct ggtccttcac ctggtgcaat gctgggtcct agccctggcc
 361 cctcaccagg ttctgcccac agcatgatgg ggccaagccc aggacctcct tcagcaggac
 421 atcccatgcc cacccagggg cctggagggt acccccagga caacatgcat cagatgcaca
 481 agcctatgga gtccatgcac gagaagggca tgcctgatga cccacgatac aaccagatga
 541 aagggatggg catgcgtca ggggcccaca caggcatggc acctccacct agtcccatgg
 601 accagcattc tcaaggttac ccctcacccc tcggcggctc tgaacatgcc tccagtcctg
 661 tcccagccag tggccatct tcaggccccc agatgtcctc tgggccagga ggggcccac
 721 tagatggttc tgatccccag gccttgggac agcaaaacag aggcccaacc ccatttaacc
 781 agaaccagct gcatcaactc agagctcaga taatggccta caagatgttg gccaggggcc
 841 agccattgcc cgaccacctg cagatggccg tgcaaggcaa gcggccgatg cctggaatgc
 901 agcaacagat gccaacacta cctccaccct cagtgtccgc cacaggaccc ggacctggac
 961 ccggccctgg ccctggcccc ggccaggac cagccctcc aaattacagt agaccccatg
1021 gtatgggagg gccaacatg cctcccccag accctcagg tgtgccccc gggatgcctg
1081 gtcagccgcc tggagggcct cccaagccat ggcctgaagg acccatggcc aatgctgctg
1141 ccccacaag cacccccacag aagctgattc ctccgcaacc aacaggccgt cctcacctg
1201 cacctcctgc tgtcccgcct gctgcctcac ctgtaatgcc accaaaaca cagtccccag
1261 ggcagccagc ccagcctgct ccattggtgc cactgcacca aagcagagc cgaatcaccc
1321 ccatccagaa gccccgaggc cttgaccccg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga ggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgcc
2161 caaaagcggg gcagctggaa gcctggcttg aaatgaaccc agggtatgaa gtagccccca
2221 ggtcagacag tgaagaaagt ggctctgaag aggaggagga ggaggaggaa gaggagcagc
2281 ctcagcccgc acagccccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata gcagtccgc ccccatggtc aacggtgtcc
```

TABLE 1-continued

```
2521  tcaaacagta ccagatcaag ggtttggagt ggctggcgtc cctgtacaac aacaacctga
2581  atggcatcct ggctgatgag atggggctgg ggaagaccat ccagaccatc gcgctcatca
2641  catacctcat ggagcacaag cgcatcaacg gccttcct catcatcgtg cctctctcga
2701  cactgtcaaa ctgggcgtat gaatttgaca agtgggcccc ctctgtggtg aaggttttct
2761  acaagggctc tccagctgca aggcgagctt ttgtcccaca gctccgcagt gggaagttca
2821  acgtcttact gaccacctat gaatatatca tcaaagacaa gcatatccta gccaagatcc
2881  gctggaagta catgattgtg gatgaaggcc accgcatgaa aaaccaccac tgcaagttga
2941  cgcaggtcct taacacacac tacgtggccc ctcggcgcct gcttcttaca ggcacaccac
3001  tgcagaacaa gctaccggag ctctgggccc tgcttaactt cctgctcccc actatcttca
3061  agagctgcag caccttcgaa cagtggttca atgcacccct tgccatgact ggagaaaagg
3121  tggacctgaa tgaagaggag actatcctca ttattcgtcg cctacacaaa gttctgcggc
3181  ccttcctgct gcggcggctc aagaaggaag ttgaagccca gctccctgag aaggtagagt
3241  atgtcatcaa atgcgacatg tcagccctgc agcgtgtgct gtaccgtcac atgcaggcca
3301  aaggtgtgct gctgactgac ggctccgaga aggacaagaa gggcaaggt ggcaccaaga
3361  cactgatgaa cactattatg caactgcgta agatctgcaa ccaccctac atgttccagc
3421  acatcgagga gtccttttct gagcacttgg ggttcaccgg cggcatcgtg caaggattgg
3481  accttaccg tgcctcaggg aaatttgaac ttcttgatag aattctaccc aaactccgtg
3541  caacgaacca taaagtgctc ctcttttgcc aaatgacctc cctcatgacc atcatgaag
3601  actactttgc ataccgtggc ttcaaatacc tcaggcttga tggaaccaca aaagcagaag
3661  accggggcat gctgttgaaa acctttaatg aacctggctc tgagtatttc attttcctgc
3721  tcagtaccg tgctgggggg ctgggcctga atctgcatc agctgacact gtgatcatct
3781  ttgacagtga ctggaatccc caccaggacc tgcaagcaca ggatcgagcc catcgcattg
3841  gacagcagaa tgaggtgcgt gttcttcgcc tgtgcacggt caacagtgtg aagagaaga
3901  tactggctgc tgccaaatac aaactcaatg tggatcagaa ggtgatccag gcaggcatgt
3961  tcgaccagaa gtcgtccagc catgagaggc gtgccttcct gcaggccatc ctggagcacg
4021  aggagcagga tgaggaggaa gatgaggtgc ctgatgatga gaccgtcaac cagatgattg
4081  cccggcacga agaagagttt gacctcttca tgcgcatgga cttggaccgc cggcgtgaag
4141  aagcccgcaa ccccaagcgg aagccacgcc tgatggaaga ggatgagctc ccatcctgga
4201  tcatcaagga tgatgccgag gtggagcggc tgacatgtga agaggaagag gagaagatgt
4261  tcggccgtgg ttctcgccac cgcaaggagg tagactacag cgactcactg acagagaagc
4321  agtggctcaa ggctatcgag gagggcacgc tggaggagat cgaagaggag gtccggcaga
4381  agaaatcttc acgtaagcgt aagcgagaca gcgaggccgg ctcctccacc ccgaccacca
4441  gcaccccgcag ccgtgacaag gatgaggaga gcaagaagca gaagaaacgt gggcggccac
4501  ctgctgagaa gctgtcccca aacccaccta acctcaccaa gaagatgaag aagatcgtgg
4561  atgctgtgat caagtacaaa gacagcagtg gacgtcagct cagcgaggtg ttcatccagc
4621  tcccctctcg caaggagctt cctgagtact atgagctcat ccgaaagcct gtggacttca
4681  agaagatcaa ggaacgcatc cgaaaccaca gtaccgcag cctcaatgac ctggagaagg
4741  atgtgatgct gctgtgccaa aacgctcaga cgttcaacct cgagggttcc ctgatctatg
4801  aggactccat cgtcctgcag tctgtcttca ccagcgtacg gcagaagatt gagaaggagg
4861  acgacagtga aggcgaggaa agcgaggagg aggaggaggg cgaggaggaa ggctccgagt
4921  ctgagtcccg ctccgtcaag gtgaagatca agctgggccg caaggagaag gcccaggacc
4981  gactcaaggg gggccgccgg cggccaagcc gggatccgc ggccaagccg gttgtgagtg
5041  acgatgacag tgaggaggaa caggaggagg accgctcagg aagtggcagt gaggaagact
5101  gaaccagaca tccctgagtc ctgaccccga ggcgctcgtc ccagccaaga tggagtagcc
5161  cttagcagtg atgggtagca ccagatgtag tttcgaactt ggagaactgt acacatgcaa
5221  tcttccacac ttttaggcag agaagtatag gcctgtctgt cggccctggc ctggcctcga
5281  gtctctacca gcattaactg tctagagagg ggacctcctg ggagcaccat ccacctcccc
5341  aggccccagt cactgtagct cagtggatgc atgcgcgtgc cggccgctcc ttgtactgta
5401  tcttactgga cagggccagc tctccaggag gctcacaggc ccagcgggta tgtcagtgtc
5461  actggagtca gacagtaata aattaaagca atgacaagcc accactggct ccctggactc
5521  cttgctgtca gcagtggctc cggggccaca gagaagaaag aaagactttt aggaactggg
5581  tctaacttat gggcaaagta cttgccttgc caggtgtatg ggtttttgcat tcccatcacc
5641  cacacaccct aaacaagcca agtcagtgag cttcaagtta gagcctccac ctcaatgtgt
5701  acgtggaaag caatcaaaga tgatgcctag catccacctc tggccctcat gtgcagatgt
5761  acacacactg aactacatac acgggacaca cacatccaca cggaggcagt ccatgacttg
5821  cactggggag atggtaccat aggcgaaagt gccacaggca caggccagg ctaatttagt
5881  cctgcagtcc tgtgctctta agatgaaggc acaagagga accccaggcg ctccaactag
5941  catgccaggc agtgacaaga ccctgcttca aatgaatcag agcccacatt cagtattgcc
6001  ctcttacccg atgcgatgcc catgccctca catgacgta tgtatatata catacatacg
6061  taaaataatt cttttttaaa ttatagacat ttttgtgtga atgttttgcc tgaatgcgtg
6121  tgtgtgtgtg tgtgtgtgtg tgtgtgtgtg tgtgtgtgta tcaagtacat tcctagagcc
6181  tacagaggtc aagggagggc attggatctg aactggagt cacatgaggc tgtgagcaac
6241  tgtgtgggtt cctgggcctt tgcaacagca gttagtactc ttcaccactg agccatttct
6301  ccaatctcaa aaagaagcat tcttttaaat gaagactgaa ataaataagt aggacttgcc
6361  ttgg
```

SEQ ID NO: 71 Mouse BRG1 Amino Acid Sequence Isoform C (NP_001167550.1)

```
  1  mstpdpplgg tprpgpspgp gpspgamlgp spgpspgsah smmgpspgpp saghpmptqg
 61  pggypqdnmh qmhkpmesmh ekgmpddpry nqmkgmgmrs gahtgmappp spmdqhsqgy
121  psplggseha sspvpasgps sgpqmssgpg gapldgsdpq algqqnrgpt pfnqnqlhql
181  raqimaykml argqplpdhl qmavqgkrpm pgmqqqmptl pppsvsatgp gpgpgpgpgp
241  gpgpappnys rphgmggpnm pppgpsgvpp gmpgqppggp pkpwpegpma naaaptstpq
301  klippqptgr pspappavpp aaspvmppqt qspgpaqpa plvplhqkqs ritpiqkprg
361  ldpveilqer eyrlqariah riqelenlpg slagdlrtka tielkalrll nfqrqlrqev
421  vvcmrrdtal etalnakayk rskrqslrea riteklekqq kieqerkrrq khqeylnsil
481  qhakdfreyh rsvtgklqkl tkavatyhan tereqkkene riekermrrl maedeegyrk
541  lidqkkdkrl ayllqqtdey vanltelvrq hkaaqvakek kkkkkkkae naegqtpaig
601  pdgepldets qmsdlpvkvi hvesgkiltg tdapkagqle awlmenpgye vaprsdsees
661  gseeeeeeee eeqpqpacpp tlpveekkki pdpdsddvse vdarhiiena kqdvddeygv
721  sqalarglqs yyavahavte rvdkqsalmv ngvlkqyqik glewlvslyn nnlngilade
```

TABLE 1-continued

```
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvlnth
 901 yvaprrllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcqmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdseagsst pttstrsrdk deeskkqkkr grppaeklsp nppnltkkmk kivdavikyk
1441 dssgrqlsev fiqlpsrkel peyyelirkp vdfkkikeri rnhkyrslnd lekdvmllcq
1501 naqtfnlegs liyedsivlq svftsvrqki ekeddsegee seeeeegeee gsesesrsvk
1561 vkiklgrkek aqdrlkggrr rpsrgsrakp vvsdddseee qeedrsgsgs eed
```

SEQ ID NO: 72 Human BRM cDNA Sequence Variant 1 (NM_003070.4, CDS: from 223 to 4995)

```
   1 gcgtcttccg gcgcccgcgg aggaggcgag ggtgggacgc tggcggagc ccgagtttag
  61 gaagaggagg ggacggctgt catcaatgaa gtcatattca taatctagtc ctctctccct
 121 ctgtttctgt actctgggtg actcagagag ggaagagatt cagccagcac actcctcgcg
 181 agcaagcatt actctactga ctggcagaga caggagagc agatgtccac gcccacagac
 241 cctggtgcga tgccccaccc agggccttcg ccggggcctg ggccttcccc tgggccaatt
 301 cttgggccta gtccaggacc aggaccatcc ccaggttccg tccacagcat gatggggcca
 361 agtcctggac ctccaagtgt ctcccatcct atgccgacga tggggtccac agacttccca
 421 caggaaggca tgcatcaaat gcataagccc atcgatgtta tacatgacaa ggggattgta
 481 gaagacatcc attgtggatc catgaagggc actggtatgc gaccacctca cccaggcatg
 541 ggccctcccc agagtccaat ggatcaacac agccaaggtt atatgtcacc acaccatct
 601 ccattaggag ccccagagca cgtctccagc cctatgtctg gaggaggccc aactccacct
 661 cagatgccac caagccagcc gggggccctc atcccaggtg atccgcaggc catgagccag
 721 cccaacagag gtccctcacc tttcagtcct gtccagctgc atcagcttcg agctcagatt
 781 ttagcttata aaatgctggc ccgaggccag cccctccccg aaacgctgca gcttgcagtc
 841 cagggggaaaa ggacgttgcc tggcttgcag caacaacagc agcagcaaca gcagcagcag
 901 cagcagcagc agcagcagca gcagcagcaa cagcagccgc agcagcagcc gccgcaacca
 961 cagacgcagc aacaacagca gccggccctt gttaactaca acagaccatc tggcccgagg
1021 ccggagctga gcggccccag cacccgcag aagctgccgg tgcccgcgcc cggcggccgg
1081 ccctcgcccg cgccccccgc agccgcgcag ccgcccgcgg ccgcagtgcc cgggccctca
1141 gtgccgcagc cggccccggg gcagccctcg cccgtcctcc agctgcagca gaagcagagc
1201 cgcatcagcc ccatccagaa accgcaaggc ctggaccccg tggaaattct gcaagagcag
1261 gaatacagac ttcaggcccg catagctcat aggatacaag aactggaaaa tctgcctggc
1321 tctttgccac cagatttaag aaccaaagca accgtggaac taaaagcact tcggttactc
1381 aatttccagc gtcagctgag acaggaggtg gtggcctgca tgcgcaggga cacgaccctg
1441 gagacggctc tcaactccaa agcatacaaa cggagcaggc gccagatcct gagagaagct
1501 cgcatgaccg agaagctgga gaagcagcag aagattgagc aggagaggaa acgccgtcag
1561 aaacaccagg aatacctgaa cagcattttg caacatgcaa aagattttaa ggaatatcat
1621 cggtctgtgg ccggaaagat ccagaagctc tccaaagcag tggcaacttg gcatgccaac
1681 actgaaagag agcagaaaga ggagacagag cggattgaaa aggagaagaat gcggcgactg
1741 atggctgaag atgaggaggg ttatagaaaa ctgattgatc aaaagaaaga caggcgttta
1801 gcttacccttt tgcagcagac cgatgagtat gtagccaatc tgaccaatct ggtttgggag
1861 cacaagcaag cccaggcagc caaagagaag aagaagagga ggaggaggaa gaagaaggct
1921 gaggagaatg cagagggtgg ggagtctgcc ctgggaccgg atggagagcc catagatgag
1981 agcagccaga tgagtgacct ccctgtcaaa gtgacccaca cagaaaccgg caaggttctg
2041 ttcggaccag aagcacccaa agcaagtcag ctggacgcct ggctggaaat gaatcctggt
2101 tatgaagttg ccctagatc tgacagtgaa gagagtgatt ctgattatga ggaagaggat
2161 gaggaagaag agtccagtag gcaggaaacc gaagagaaaa tactcctgga tccaaatagc
2221 gaagaagttt ctgagaagga tgctaagcag atcattgaga cagctaagca agacgtggat
2281 gatgaataca gcatgcagta cagtgccagg ggctcccagt cctactacac cgtggctcat
2341 gccatctcgg agagggtgga gaaacagtct gccctcctaa ttaatgggac cctaaagcat
2401 taccagctcc agggcctgga atggatggtt tccctgtata ataacaactt gaacggaatc
2461 ttagccgatg aaacgggct tggaaagacc atacagacca ttgcactcat cacttatctg
2521 atggagcaca aaagactcaa tggcccctat ctcatcattg ttccccttc gactctatct
2581 aactggacat atgaatttga caaatgggct ccttctgtgg tgaagatttc ttacaaggt
2641 actcctgcca tgcgtcgctc ccttgtcccc cagctacgga gtggcaaatt caatgtcctc
2701 ttgactactt atgagtatat tataaaagac aagcacattc ttgcaaagat tcggtggaaa
2761 tacatgatag tggacgaagg ccaccgaatg aagaatcacc actgcaagct gactcaggtc
2821 ttgaacactc actatgtggc ccccagaagg atcctcttga ctgggacccc gctgcagaat
2881 aagctccctg aactctgggc cctcctcaac ttcctcctcc aacaattt taagagctgc
2941 agcacatttg aacaatggtt caatgctcca tttgccatga ctggtgaaag ggtggactta
3001 aatgaagaag aaactatatt gatcatcagg cgtctacata aggtgttaag accatttta
3061 ctaaggagac tgaagaaaga agttgaatcc cagcttcccg aaaagtgga atatgtgatc
3121 aagtgtgaca tgtcagctct gcagaagatt ctgtatcgcc atatgcaagc caaggggatc
3181 cttctcacag atggttctga gaaagataag aaggggaaag gaggtgctaa gacttatg
3241 aacactatta tgcagttgag aaaatctgc aaccaccat atatgtttca gcacattgtg
3301 gaatcctttg ctgaacacct aggctattca aatgggtca tcaatgggc tgaactgtat
3361 cgggcctcag ggaagtttga gctgcttgat cgtattctgc aaaattgag agcgactaat
3421 caccgagctc tgcttttctg ccagatgaca tccctcatga ccatcatgga ggattattct
3481 gcttttcgga acttcctta cctacgcctt gatgcgacca ccagtctga agatcgtgct
3541 gctttgctga agaaaattcaa tgaacctgga tcccagtatt tcatttttctt gctgagcaca
3601 agagctgtg gcctgggctt aaatcttcag gcagctgata cagtggtcat ctttgacagc
3661 gactggaatc ctcatcagga tctgcaggcc caagaccgag ctcaccgcat cggcagcag
3721 aacgaggtcc gggtactgag gctctgtacc gtgaacagcg tggaggaaaa gatcctcgcg
```

TABLE 1-continued

```
3781 gccgcaaaat acaagctgaa cgtggatcag aaagtgatcc aggcgggcat gtttgaccaa
3841 aagtcttcaa gccacgagcg gagggcattc ctgcaggcca tcttggagca tgaggaggaa
3901 aatgaggaag aagatgaagt accggacgat gagactctga accaaatgat tgctcgacga
3961 gaagaagaat ttgacctttt tatgcggatg gacatggcc ggcggaggga agatgcccgg
4021 aacccgaaac ggaagccccg tttaatggag gaggatgagc tgccctcctg gatcattaag
4081 gatgacgctg aagtagaaag gctcacctgt gaagaagagg aggagaaaat atttgggagg
4141 gggtcccgcc agcgccgtga cgtggactac agtgacgccc tcacggagaa gcagtggcta
4201 agggccatcg aagacggcaa tttggaggaa atggaagagg aagtacggct taagaagcga
4261 aaaagacgaa gaaatgtgga taaagatcct gcaaaagaag atgtggaaaa agctaagaag
4321 agaagaggcc gccctcccgc tgagaaactg tcaccaaatc cccccaaact gacaaagcag
4381 atgaacgcta tcatcgatac tgtgataaac tacaaagata ggtgtaacgt ggagaaggtg
4441 cccagtaatt ctcagttgga aatagaagga aacagttcag gcgacagctc cagtgaagtc
4501 ttcattcagt taccttcaag gaaagaatta cagaatact atgaattaat taggaagcca
4561 gtggattca aaaaaataaa ggaaaggatt cgtaatcata agtaccggag cctaggcgac
4621 ctggagaagg atgtcatgct tctctgtcac aacgctcaga cgttcaacct ggagggatcc
4681 cagatctatg aagactccat cgtcttacag tcagtgttta agagtgcccg gcagaaaatt
4741 gccaaagagg aagagagtga ggatgaaagc aaggaaaga aggaagaga agatgaagaa
4801 gagtcagagt ccgaggcaaa atcagtcaag gtgaaaatta agctcaataa aaaagatgac
4861 aaaggccggg acaaaggaa aggcaagaaa aggccaaatc gaggaaaagc caaacctgta
4921 gtgagcgatt ttgacagcga tgaggagcag gatgaacgtg aacagtcaga aggaagtggg
4981 acggatgatg agtgatcagt atggaccttt ttccttggga gaactgaatt cctcctccc
5041 ctgtctcatt tctacccagt gagttcattt gtcatatagg cactggggtt ttctatatc
5101 atcatcgtct ataaactagc tttaggatag tgccagacaa acatatgata tcatggtgta
5161 aaaaacacac acatacacaa atatttgtaa catattgtga ccaaatgggc ctcaaagatt
5221 cagattgaaa caaacaaaaa gcttttgatg gaaaatatgt gggtggatag tatatttcta
5281 tgggtgggtc taatttggta acggtttgat tgtgcctggt tttatcacct gttcagatga
5341 gaagatttt gtcttttgta gcactgataa ccaggagaag ccattaaaag ccactggtta
5401 tttatttt catcaggcaa ttttcgaggt ttttatttgt tcggtattgt tttttacac
5461 tgtggtacat ataagcaact ttaataggtg ataaatgtac agtagttaga tttcacctgc
5521 atatacattt ttccatttta tgctctatga tctgaacaaa agctttttga attgtataag
5581 atttatgtct actgtaaaca ttgcttaatt tttttgctct tgattttaaaa aaaagttttg
5641 ttgaaagcgc tattgaatat tgcaatctat atagtgtatt ggatggcttc ttttgtcacc
5701 ccgatctcct atgttaccaa tgtgtatcgt ctccttctcc ctaaagtgta cttaatcttt
5761 gctttcttttg cacaatgtct ttggttgcaa gtcataagcc tgaggcaaat aaaattccag
5821 taatttcgaa gaatgtggtg ttggcgcttt cctaataaag aaataattta gcttgacaaa
5881 aaaaaaaaaa aa
```

SEQ ID NO: 73 Human BRM Amino Acid Sequence Isoform A (NP_003061.3)

```
   1 msrptdpgam phpgpspgpg pspgpilgps pgpgpspgsv hsmmgpspgp psvshpmptm
  61 gstdfpqegm hqmhkpidgi hdkgivedih cgsmkgtgmr pphpgmgppq spmdqhsqgy
 121 msphpsplga pehvsspmsg ggptppqmpp sqpgalipgd pqamsqpnrg pspfspvqlh
 181 qlraqilayk mlargqplpe tlqlavqgkr tlpglqqqqq qqqqqqqqqq qqqqqqqqpq
 241 qqppqpqtqq qqqpalvnyn rpsgpgpels gpstpqklpv papggrpspa ppaaaqppaa
 301 avpgpsvpqp apgqpspvlq lqqkqsrisp iqkpqgldpv eilqereyrl qariahriqe
 361 lenlpgslpp dlrtkatvel kalrllnfqr qlrqevvacm rrdttletal nskaykrskr
 421 qtlrearmte klekqqkieq erkrrqkhqe ylnsilqhak dfkeyhrsva gkiqklskav
 481 atwhantere qkketeriek ermrrlmaed eegyrklidq kkdrrlayll qqtdeyvanl
 541 tnlvwehkqa qaakekkkrr rrkkkaeena eggesalgpd gepidessqm sdipvkvtht
 601 etgkvlfgpe apkasqldaw lemnpgyeva prsdseesds dyeeedeeee ssrqeteeki
 661 lldpnseevs ekdakqiiet akqdvddeys mqysargsqs yytvahaise rvekqsalli
 721 ngtlkhyqlq glewmvslyn nnlngilade mglgktiqti alitylmehk rlngpyliiv
 781 plstlsnwty efdkwapsvv kisykgtpam rrslvpqlrs gkfnvlltty eyiikdkhil
 841 akirwkymiv deghrmknhh ckltqvlnth yvaprrillt gtplqnklpe lwallnfllp
 901 tifkscstfe qwfnapfamt gervdlneee tiliirrlhk vlrpfllrrl kkevesqlpe
 961 kveyvikcdm salqkilyrh mqakgilltd gsekdkkgkg gaktlmntim qlrkicnhpy
1021 mfqhieesfa ehlgysngvi ngaelyrasg kfelldrilp klratnhrvl lfcqmrslmt
1081 imedyfafrn flylrldgtt ksedraallk kfnepgsqyf iflstragg lglnlqaadt
1141 vvifdsdwnp hqdlqaqdra hrigqqnevr vlrlctvnsv eekilaaaky klnvdqkviq
1201 agmfdqksss herraflqai leheeeneee devpddetln qmiarreeef dlfmrmdmdr
1261 rredarnpkr kprlmeedel pswiikddae verltceeee ekifgrgsrq rrdvdysdal
1321 tekqwlraie dgnleemeee vrlkkrkrrr nvdkdpaked vekakkrrgr ppaeklspnp
1381 pkltkqmnai idtvinykdr cnvekvpsns qleiegnssg rqlsevfiql psrkelpeyy
1441 elirkpvdfk kikerirnhk yrslgdlekd vmllchnaqt fnlegsqiye dsivlqsvfk
1501 sarqkiakee esedesneee eeeedeeeses eaksvkvkik lnkkddkgrd kgkgkkrpnr
1561 gkakpvvsdf dsdeeqdere qsegsgtdde
```

SEQ ID NO: 74 Human BRM cDNA Sequence Variant 2 (NM_139045.3, CDS: from 223 to 4941)

```
   1 gcgtcttccg gcgcccgcgg aggaggcgag ggtgggacgc tgggcggagc ccgagtttag
  61 gaagaggagg ggacggctgt catcaatgaa gtcatattca taatctagtc ctctctccct
 121 ctgtttctgt actctgggtg actcagagag ggaagagatt cagccagcac actccccgcg
 181 agcaagcatt actctactga ctggcagaga caggagaggt agatgtccac gcccacagac
 241 cctggtgcga tgccccaccc agggccttcg ccggggcctg ggccttcccc tgggccaatt
 301 cttgggccta gtccaggacc aggaccatcc ccaggttccg tccacagcat gatggggcca
 361 agtcctggac ctccaagtgt ctcccatcct atgccgacga tggggtccaa agacttccca
 421 caggaaggca tgcatcaaat gcataagccc atcgatggta tacatgacaa ggggattgta
 481 gaagacatcc attgtgatc catgaagggc actggtatgc gaccacctca cccaggcatg
 541 ggccctcccc agagtccaat ggatcaacac agccaagatt atatgtcacc acacccatct
 601 ccattaggag ccccagagca cgtctccagc cctatgtctg gaggaggccc aactccacct
 661 cagatgccac caagccagcc gggggccctc atcccaggtg atccgcaggc catgagccag
```

TABLE 1-continued

```
 721 cccaacagag gtccctcacc tttcagtcct gtccagctgc atcagcttcg agctcagatt
 781 ttagcttata aaatgctggc ccgaggccag ccctccccg aaacgctgca gcttgcagtc
 841 caggggaaaa ggacgttgcc tggcttgcag caacaacagc agcagcaaca gcagcagcag
 901 cagcagcagc agcagcagca gcagcagcaa cagcagcagc agcagcagcc gccgcaacca
 961 cagacgcagc aacaacagca gccggcccct gttaactaca acagaccatc tggcccgggg
1021 ccggagctga gcggcccgag caccccgcag aagctgccgg tgcccgcgcc cggcggccgg
1081 ccctcgcccg cgcccccgc agccgcgcag ccgccgcgcg ccgcagtgcc cgggccctca
1141 gtgccgcagc cggccccggg gcagccctcg cccgtcctcc agctgcagca gaagcagagc
1201 cgcatcagcc ccatccagaa accgcaaggc ctggaccccg tggaaattct gcaagagcag
1261 gaatacagac ttcaggcccg catagctcat aggatacaag aactggaaaa tctgcctggc
1321 tctttgccac cagatttaag aaccaaagca accgtggaac taaaagcact tcggttaccc
1381 aatttccagc gtcagctgag acaggaggtg gtggcctgca tgcgcaggga cacgaccctg
1441 gagacggctc tcaactccaa agcatacaaa cggagcaagc gccagactct gagagaagct
1501 cgcatgaccg agaagctgga gaagcagcag aagattgagc aggagaggaa acgccgtcag
1561 aaacaccagg aatacctgaa cagtattttg caacatgcaa aagattttaa ggaatatcat
1621 cggtctgtgg ccggaaagat ccgaagctc tccaaagcag tggcaacttg gcatgccaac
1681 actgaaagag agcagaaaa ggagacagag cggattgaaa aggagagaat gcggcgactg
1741 atggctgaag atgaggaggg ttatagaaaa ctgattgatc aaaagaaaga caggcgttta
1801 gcttacctt tgcagcagac cgatgagtat gtagccaatc tgaccaatct ggtttgggag
1861 cacaagcaag cccaggcagc caaagagaag aagaagagga ggaggaggaa gaagaaggct
1921 gaggagaatg cagagggtgg ggagtctgcc ctgggaccgg atggagagcc catagatgag
1981 agcagccaga tgagtgaccct ccctgtcaaa gtgactcaca cagaaaccgg caaggttctg
2041 ttcggaccag aagcacccaa agcaagtcag ctggacgcct ggctggaaat gaatcctggt
2101 tatgaagttg cccctagatc tgacagtgaa gagagtgatt ctgattatga ggaagaggat
2161 gaggaagaag agtccagtag gcaggaaacc gaagagaaaa tactcctgga tccaaatagc
2221 gaagaagttt ctgagaagtga tgctaagcag atcattgaga cagctaagca agacgtggat
2281 gatgaataca gcatgcagta cagtgccagg ggctcccagt cctactacac cgtggctcat
2341 gccatctcgg agagggtgga gaaacagtct gccctcctaa ttaatgggac cctaaagcat
2401 taccagctcc agggcctgga atggatggtt tccctgtata acaacaactt gaacggaatc
2461 ttagccgatg aaatggggct tggaaagacc atacagacca ttgcactcat cacttatctg
2521 atggagcaca aaagactcaa tggcccctat ctcatcattg ttccccttc gactctatct
2581 aactggacat atgaatttga caaatgggct ccttctgtgg tgaagatttc ttacaagggt
2641 actcctgcca tgcgtcgctc ccttgtcccc cagctacgga gtggcaaatt caatgtcctc
2701 ttgactactt atgagtatat tataaaagac aagcacattc ttgcaaagat tcggtgaaa
2761 tacatgatag tggacgaagg ccaccgaatg aagaatcacc actgcaagct gactcaggtc
2821 ttgaacactc actatgtggc ccccagaagg atcctcttga ctgggacccc gctgcagaat
2881 aagctccctg aactctgggc cctcctcaac ttcctcctcc caacaatttt taagagctgc
2941 agcacatttg aacaatggtt caatgctcca tttgccatga ctggtgaaag ggtggactta
3001 aatgaagaag aaactatatt gatcatcagg cgtctacata aggtgttaag accatttta
3061 ctaaggagac tgaagaaaga agttgaatcc cagcttcccg aaaaagtgga atatgtgatc
3121 aagtgtgaca tgtcagctct gcagaagatt ctgtatcgcc atatgcaagc caaggggatc
3181 cttctcacag atggttctga gaaagataag aagggaaag gaggtgctaa gacacttatg
3241 aacactatta tgcagttgag aaaaatctgc aaccacccat atatgtttca gcacattgga
3301 gaatcctttg ctgaacacct aggctattca aatgggtca tcaatggggc tgaactgtat
3361 cgggcctcag ggaagtttga gctgcttgat cgtatcctgc aaaattgag agcgactaat
3421 caccgagtgc tgcttttctg ccagatgaca tctctcatga ccatcatgga ggattattt
3481 gctttcgga acttcctta cctacgcctt gatgccacca ccaagtctga agatcgtgct
3541 gctttgctga agaaattcaa tgaacctgga tcccagtatt tcatttcctt gctgagcaca
3601 agagctggtg gcctgggctt aaatcttcag gcagctgata cagtggtcat ctttgacagc
3661 gactggaatc ctcatcagga tctgcaggcc caagaccagg ctcaccgcat cgggcagcag
3721 aacgaggtcc gggtactgag gctctgtacc gtgaacagcg tggaggaaaa gatcctcgcg
3781 gccgcaaaat acaagctgaa cgtggatcag aaagtgatcc aggcgggcat gttttgaccaa
3841 aagtcttcaa gccacgagcg gagggcattc ccgcaggcca tcttggagca tgaggaggaa
3901 aatgaggaag aagatgaagt accggacgat gagactctga accaaatgat tgctcgacga
3961 gaagaagaat ttgaccttt tatgcggatg gacatggacc ggcggaggga agatgcccgg
4021 aacccgaaac ggaagcccg tttaatggag gaggatgagc tgccccctg gatcattaag
4081 gatgacgctg aagtagaaag gctcacctgt gaagaagagg aggagaaat atttgggagg
4141 gggtcccgcc agcgccgtga cgtggactac agtgacgccc tcacggagaa gcagtggcta
4201 agggccatcg aagacgcaa tttggaggaa atggaagagg aagtacggct taagaagcga
4261 aaaagacgaa gaaatgtgga taagatcct gcaaaagaag atgtggaaaa agctaagaag
4321 agaagaggcc gccctcccgc tgagaaactg tcaccaaatc cccccaaact gacaaagcag
4381 acgaacgcta tcatcgatac tgtgataaac tacaaagata gttcagggcg acagctcagt
4441 gaagtcttca ttcagttacc ttcaaggaaa gaattaccag aatactatga attaattagg
4501 aagccagtgg attcaaaa aataaaggaa aggattcgta atcataagta ccggagccta
4561 ggcgacctgg agaaggatgt catgcttctc tgtcacaacg ctcagacgtt caacctggaa
4621 ggatcccaga tctatgaaga ctccatcgtc ttacagtcag tgtttaagag tgcccggcag
4681 aaaattgcca aagaggaaga gagtgaggat gaagcaagtg aagaggaga agaggaagat
4741 gaagaagagt cagagtccga ggcaaaatca gtcaaggtga aaattaagct caataaaaaa
4801 gatgacaaag gccgggacaa agggaaaggc aagaaaaggc caaatcgagg aaaagccaaa
4861 cctgtagtga gcgatttcga cagcgatgag gagcaggatg aacgtgaaca gtcagaagga
4921 agtgggacgg atgatgagtg atcagtatgg accttttcc ttggtagaac tgaattcctt
4981 cctccccgt ctcatttcta cccagtgagt tcattttgca tataggcact gggttgtttc
5041 tatatcatca tcgtctataa actagctta ggatagtgcc agacaaacat atgatatcat
5101 ggtgtaaaaa acacacacat acacaaatat ttgcaacata ttgtgaccaa atgggcctca
5161 aagattcaga ttgaaacaaa caaaagctt ttgatggaaa atatgtgggt ggatagtata
5221 tttctatggg tgggtctaat ttggtaacgg tttgattgtg cctggttta tcacctgttc
5281 agatgagaag atttttgtct tttgtagcac tgataaccag gagaagccat taaaagccac
5341 tggttatttt atttttcatc aggcaatttt cgaggtttt atttgttcgg tattgctttt
5401 ttacactgtg gtacatataa gcaactttaa taggtgataa atgtacagta gtcagatttc
5461 acctgcatat acatttttcc attttatgct ctatgatctg aacaaaagct ttttgaactg
```

TABLE 1-continued

```
5521 tataagattt atgtctactg taaacattgc ttaattttt tgctcttgat ttaaaaaaaa
5581 gctttgttga aagcgctatt gaatattgca atctatatag tgtattggat ggcttctttt
5641 gtcaccctga tctcctatgt taccaatgtg tatcgtctcc ttctccctaa agtgtactta
5701 atctttgctt tctttgcaca atgtctttgg ttgcaagtca taagcctgag gcaaataaaa
5761 ttccagtaat ttcgaagaat gtggtgttgg tgctttccta ataaagaaat aatttagctt
5821 gacaaaaaaa aaaaaaaa
```

SEQ ID NO: 75 Human BRM Amino Acid Sequence Isoform B (NP_620614.2)

```
    1 mstptdpgam phpgpspgpg pspgpilgps pgpgpspgsv hsmmgpspgp psvshpmptm
   61 gstdfpqegm hqmhkpidgi hdkgivedih cgsmkgtgmr pphpgmgppq spmdqhsqgy
  121 msphpsplga pehvsspmsg ggptppqmpp sqpgalipgd pqamsqpnrg pspfspvqlh
  181 qlraqilayk mlargqplpe tlqlavqgkr tlpglqqqqq qqqqqqqqq qqqqqqqpq
  241 qqppqpqtqq qqqpalvnyn rpsgpgpels gpstpqklpv papggrpspa ppaaaqppaa
  301 avpgpsvpqp apgqpspvlq lqqkqsrisp iqkpqgldpv eilqereyrl qariahriqe
  361 lenlpgslpp dlrtkatvel kalrllnfqr qlrqevvacm rrdttletal nskaykrskr
  421 qtlrearmte klekqqkieq erkrrqkhqe ylnsilqhak dfkeyhrsva gkiqklskav
  481 atwhantere qkketeriek ermrrlmaed eegyrklidq kkdrrlayll qqtdeyvanl
  541 tnlvwehkqa qaakekkkrr rrkkkaeena eggesalgpd gepidessqm sdlpvkvtht
  601 etgkvlfgpe apkasqldaw lemnpgyeva prsdseesds dyeeedeeee ssrqeteeki
  661 lldpnseevs ekdakqiiet akqdvddeys mqysargsqs yytvahaise rvekqsalli
  721 ngtlkhyqlq glewmvslyn nnlngilade rlngpyliiv plstlsnwty etdkwapsvv
  781 plstlsnwty etdkwapsvv kisykgtpam rrslvpqlrs gkfnvlltty eyiikdkhil
  841 akirwkymiv deghrmknhh ckltqvlnth yvaprrillt gtplqnklpe lwallnfllp
  901 tifkscstfe qwfnapfamt gervdlneee tiliirrlhk vlrpfllrrl kkevesqlpe
  961 kveyvikcdm salqkilyrh mqakgilltd gsekdkkgkg gaktlmntim qlrkicnhpy
 1021 mfqhieesfa ehlgysngvi ngaelyrasg kfelldrilp klratnhrvl lfcqmtslmt
 1081 imedyfafrn flylrldgtt ksedraallk kfnepgsqyf ifllstragg lglnlqaadt
 1141 vvifdsdwnp hqdlqaqdra hriqqnevr vlrlctvnsv eekilaaaky klnvdqkviq
 1201 agmfdqksss herraflqai leheeeneee devpddetln qmiarreeef dlfmrmdmdr
 1261 rredarnpkr kprlmeedel pswiikddae verltceeee ekifgrgsrq rrdvdysdal
 1321 tekqwlraie dgnleemeee vrlkkrkrrr nvdkdpaked vekakkrrgr ppaeklspnp
 1381 pkltkqmnai idtvinykds sgrqlsevfi qlpsrkelpe yyelirkpvd fkkikerirn
 1441 hkyrslgdle kdvmllchna qtfnlegsqi yedsivlqsv fksarqkiak eeesedesne
 1501 eeeeedeees eseaksvkvk iklnkkddkg rdkgkgkkrp nrgkakpvvs dfdsdeeqde
 1561 reqsegsgtd de
```

SEQ ID NO: 76 Human BRM cDNA Sequence Variant 3 (NM_001289396.1, CDS: from 210 to 4982)

```
    1 tcagaagaaa gccccgagat cacagagacc cggcgagatc acagagaccc ggcctgaagg
   61 aacgtggaaa gaccaatgta cctgttttga ccggttgcct ggagcaagaa gttccagttg
  121 gggagaattt tcagaagata aagtcggaga ttgtggaaag acttgacttg cagcattact
  181 ctactgactg gcagagacag gagaggtaga tgtccacgcc cacagccct ggtgcgatgc
  241 cccacccagg gccttcgccg gggcctgggc cttccctg gccaattctt gggcctagtc
  301 caggaccagg accatcccca ggttccgtcc acagcatgat ggggccaagt cctggacctc
  361 caagtgtctc ccatcctatg ccgacgatgg ggtccacaga cttcccacag gaaggcatgc
  421 atcaaatgca taagcccatc gatggtatac attgacaaggg gattgtagaa gacatccatt
  481 gtggatccat gaagggcact ggtatgcgac cacctcaccc aggcatgggc cctccccaga
  541 gtccaatgga tcaaacagc caaggttata tgtcaccaca cccatctcca ttaggagccc
  601 cagagcacgt cccccagccct atgtctggag gagggcccaac tccacctcag atgccaccaa
  661 gccagccggg ggccctcatc ccaggtgatc gcaggccat gagccagccc aacagaggtc
  721 cctcaccttt cagtcctgtc cagctgcatc agcttcgagc tcagattta gcttataaaa
  781 tgctggcccg aggcagccc ctccccgaaa cgctgcagct tgcagtccag gggaaaagga
  841 cgttgcctgg cttgcagcaa caacagcagc agcaacagca gcagcagcag cagcagcagc
  901 agcagcagca gcagcaacag cagccgcagc agcaaccacag acgcagcaac
  961 aacagcagcc ggcccttgtt aactacaaca gaccatctg cccgggggcg gagctgagcg
 1021 gccccgagcac cccgcagaag ctgccggtgc ccgcgccgg cggccggccc tcgccgcgc
 1081 ccccgcagc cgcgcagccg cccgcggcg cagtgccgg gccctcagtg ccgcagccgg
 1141 ccccgggca gccctcgccc gtcctccagc tgcagcagaa gcagagccgc atcagcccca
 1201 tccagaaacc gcaaggcctg gaccccgtgg aaattctgca agagcgggaa tacagacttc
 1261 aggcccgcat agctcatagg atacaagaac tggaaaatcc gcctggctct tgccaccag
 1321 atttaagaac caaagcaacc gtgaactaa agcacttcg gttactcaat ttccagcgtc
 1381 agctgagaca ggaggtggtg gcctgcatgc gcagggcacac gaccctggag acggctctca
 1441 actccaaagc atacaaacgg agcaagcgcc agactctgag agaagctcgc atgaccgaga
 1501 agctggagaa gcagcagaag attgagcagg agaggaaacg ccgtcagaaa caccaggaat
 1561 acctgaacag tattttgcaa catgcaaaag attttaagga atatcatcgg tctgtggccg
 1621 gaaagatcca gaagctctcc aaagcagtgg caacttggca tgccaacact gaaagagagc
 1681 agaagaagga gacagagcgg attgaaaagg agagaatgcg gcgactgatg gctgaagatg
 1741 aggagggtta tagaaaactg attgatcaaa agaaagacag gcgtttagct tacctttgc
 1801 agcagaccga tgagtatgta gccaatctga ccaatctggt ttgggagcac aagcaagccc
 1861 aggcagccaa agagaagaag aagaggagga ggaggaagaa gaaggctgag gagaatgcag
 1921 agggtgggga gtctgccctg ggaccggatg gagagccat agatgagagc agccagatga
 1981 gtgacctccc tgtcaaagtg actcacacag aaaccggcaa ggttctgttc ggaccagaga
 2041 cacccaaagc aagtcagctg gacgcctggc tggaaatgaa tcctggttat gaagttgccc
 2101 ctagatctga cagtgaagag agtgattctg attatgagga gaggatgag gaagaagagt
 2161 ccagtaggca ggaaaccgaa gagaaaatac tcctggatcc aaatagcgaa gaagtttctg
 2221 agaaggatgc taagcagatc attgagacag ctaagcaaga cgtggacgat gaatacgca
 2281 tgcagtacag tgccaggggc tcccagtcct actacaccgt ggctcatgcc atctcggaga
 2341 gggtggagaa acagtctgcc ctcctaatta tgggaccct aaagcattac cagctccagg
 2401 gcctggaatg gatggttttc ctgtataata acaacttgaa cggaatctta gccgatgaaa
 2461 tggggcttgg aaagaccata cagaccattg cactcatcac ttatctgatg gagcacaaaa
```

TABLE 1-continued

```
2521 gactcaatgg ccccctatctc atcattgttc ccctttcgac tctatctaac tggacatacg
2581 aatttgacaa atgggctcct tctgtggtga agatttctta caagggtact cctgccatgc
2641 gtcgctccct tgtcccccag ctacggagtg gcaaattcaa tgtcctcttg actacttatg
2701 agtatattat aaaagacaag cacattcttg caaagatcg gtggaaatac atgatagtgg
2761 acgaaggcca ccgaatgaag aatcaccact gcaagctgac tcaggtcttg aacactcact
2821 atgtggcccc cagaaggatc ctcttgactg ggacccgct gcagaataag ctccctgaac
2881 tctgggcct cctcaacttc ctcctcccaa caattttaa gagctgcagc acatttgaac
2941 aatggttcaa tgctccattt gccatgactg gtgaaagggt ggacttaaat gaagaagaa
3001 ctatattgat catcaggcgt ctacataagg tgttaagacc attttacta aggagactga
3061 agaaagaagt tgaatcccag cttcccgaaa aagtggaata tgtgatcaag tgtgacatgt
3121 cagctctgca gaagattctg tatcgccata tgcaagccaa ggggatcctt ctcacagatg
3181 gttctgagaa agataagaag gggaaggag tgctaagac acttatgaac actattatgc
3241 agttgagaaa aatctgcaac cacccatata tgtttcagca cattgaggaa tcctttgctg
3301 aacacctagg ctattcaaat ggggtcatca atggggctga actgtatcgg gcctcaggga
3361 agtttgagct gcttgatcgt attctgccaa aattgagagc gactaatcac cgagtgctgc
3421 ttttctgcca gatgacatct ctcatgacca tcatggagga ttattttgct tttcggaact
3481 tcctttacct acgccttgat ggcaccacca agtctgaaga tcgtgctgct ttgctgaaga
3541 aattcaatga acctggatcc cagtatttca ttttcttgct gagcacaaga gctggtggcc
3601 tgggcttaaa tcttcaggca gctgatacag tggtcatctt tgacagcgac tggaatcctc
3661 atcaggatct gcaggcccaa gaccgagctc accgcatcgg gcagcagaac gaggtccggg
3721 tactgagct ctgtaccgtg aacagcgtgg aggaaaagat cctcgcggcc gcaaaataca
3781 agctgaacgt ggatcagaaa gtgatccagg cgggcatgtt tgaccaaaag tcttcaagcc
3841 acgagcggag ggcattcctg caggccatct tggagcatga ggaggaaaat gaggaagaag
3901 atgaagtacc ggacgatgag actctgaacc aaatgattgc tcgacgagaa aagaatttg
3961 accttttat gcggatggac atggaccggc ggaggaga tgcccgaaga ccgaaaccgga
4021 agccccgttt aatggaggac gatgagctgc cctcccggat cattaaggat gacgctgaag
4081 tagaaaggct cacctgtgaa gaagaggagg agaaaatatt tgggaggggg tcccgccagc
4141 gccgtgacgt ggactacagt gacgccctca cggagaagca gtggctaagg gccatcgaag
4201 acggcaattt ggaggaaatg gaagaggaag tacggcttaa gaagcgaaaa agacgaagaa
4261 atgtggataa agatcctgca aaagaagatg tggaaaaagc taagaagaga agaggccgcc
4321 ctcccgctga gaaactgtca ccaaatcccc ccaaactgac aaagcagatg aacgctatca
4381 tcgatactgt gataaactac aaagataggt gtaacgtgga gaaggtgccc agtaattctc
4441 agttggaaat agaaggaaac agttcagggc gacagctcag tgaagtcttc attcagttac
4501 cttcaaggaa agaattacca gaatactatg aattaattag gaagccagtg gatttcaaaa
4561 aaataaagga aaggattcgt aatcataagt accggagcct aggcgacctg gagaaggatg
4621 tcatgcttct ctgtcacaac gctcagacgt tcaacctgga gggatcccag atctatgaag
4681 actccatcgt cttacagtca gtgtttaaga gtgcccggca gaaaattgcc aaagaggaag
4741 agagtgagga tgaaagcaat gaagaggagg aaggagaga tgaagaagaa tcagagtccg
4801 aggcaaaatc agtcaaggtg aaaattaagc tcaataaaaa agatgacaaa ggccgggaca
4861 aagggaaagg caagaaaagg ccaaatcgag gaaaagccaa acctgtagtg agcgattttg
4921 acagcgatga ggagcaggat gaacgtgaac agtcagaagg aagtgggacg gatgatgagt
4981 gatcagcatg gaccttttc cttggtagaa tcgaattcct tcctccctg tctcattct
5041 acccagtgag ttcatttgtc atataggcac tgggttgttt ctatatcatc atcgtctata
5101 aactagcttt aggatagtgc cagacaaaca tatgatatca tggtgtaaa aacacacaca
5161 tacacaaata tttgtaacat attgtgacca aatgggcctc aaagattcag attgaaacaa
5221 acaaaaagct tttgatggaa aatatgtggg tggatagtat atttctatgg gtgggtctaa
5281 tttggtaacg gtttgattgt gcctggtttt atcacctgtt cagatgagaa gattttttgtc
5341 ttttgtagca ctgataacca ggagaagcca ttaaaagcca ctggttattt tattttcat
5401 caggcaattt tcgaggtttt tatttgttcg gtattgtttt tttacactgt ggtacatata
5461 agcaacttta ataggtgata aatgtacagt agttagattt cacctgcata tacattttc
5521 catttatgc tctatgatct gaacaaaagc ttttgaatt gtaaagatt tatgtctact
5581 gtaaacattg cttaattttt ttgctcttga tttaaaaaaa agttttgttg aaagcgctat
5641 tgaatattgc aatctatata gtgtattgga tggcttcttt tgtcaccctg atctcctatg
5701 ttaccaatgt gtatcgtctc cttctcccta aagtgtactt aatctttgct ttctttgcac
5761 aatgtctttg gttgcaagtc ataagcctga ggcaaataaa attccagtaa tttcgaagaa
5821 tgtggtgttg gtgcttttcct aataaagaaa taatttagct tgacaaaaaa aaaaaaaaa
```

SEQ ID NO: 77 Human BRM cDNA Sequence Variant 4 (NM_001289397.1, CDS: from 223 to 4767)

```
    1 gcgtcttccg gcgcccgcgg aggaggcgag ggtgggacgc tgggcggagc ccgagtttag
   61 gaagaggagg ggacggctgt catcaatgaa gtcatattca taatctagtc ctctctccct
  121 ctgtttcgt actctgggtg actcagagag ggaagagatt cagccagcac actcctcgcg
  181 agcaagcatt actctactga ctggcagaga caggagaggt agatgtccac gcccacagac
  241 cctggtgcga tgccccaccc agggccttcg ccggggcctg gccttcccc tgggccaatt
  301 cttgggccta gtccaggacc aggaccatcc ccaggttccg tccacagcat gatggggcca
  361 agtcctggac ctccaagtgt ctcccatcct atgccgacga tggggtccac agacttccca
  421 caggaaggca tgcaccaaat gcataagccc atcgatgggta tacatgacaa ggggattgta
  481 gaagacatcc attgtggatc catgaagggc actggtatgc gaccacctca cccaggcatg
  541 ggccctcccc agagtccaat ggatcaacac agccaaggtt acatgtcacc acacccatct
  601 ccattaggag ccccagagca cgtctccagc cctatgtctg gaggaggccc aactccacct
  661 cagatgccac caagccagcc gggggccctc accccaggtg atccgcaggc catgagccag
  721 cccaacagag gtccctcacc tttcagtcct gtccagctgc atcagcttcg agctcagatt
  781 ttagcttata aaatgctggc ccgaggccag cccctcccg aaacgctgca gcttgcagtc
  841 caggggaaaa ggacgttgcc tggcttgcag caacaacagc agcagcaaca gcagcagcag
  901 cagcagcagc agcagcagca gcagcagcaa cagcagcagc agcagcagcc gccgcaacca
  961 cagacgcagc aacaacagca gccggcctt gttaactaca acagaccatc tggcccgggg
 1021 ccggagctga gcggcccgag caccccgcag aagctgccgg tgcccgcgcc cggcggccgg
 1081 ccctcgcccg cgccccgc agccgcgcag ccgccgcgcg ccgcagtgcc cgggccctca
 1141 gtgccgcagc cggccccggg gcagccctcg cccgtcctcc agctgcagca gagcagagc
 1201 cgcatcagcc ccatccagaa accgcaaggc ctggaccccg tgaaactct gcaagagcgg
```

TABLE 1-continued

```
1261 gaatacagac ttcaggcccg catagctcat aggatacaag aactggaaaa tctgcctggc
1321 tctttgccac cagatttaag aaccaaagca accgtggaac taaaagcact tcggttactc
1381 aatttccagc gtcagctgag acaggaggtg gtggcctgca tgcgcaggga cacgaccctg
1441 gagacggctc tcaactccaa agcatacaaa cggagcaagc gccagatctc gagagaagct
1501 cgcatgaccg agaagctgga gaagcagcag agaattggac aggagaggaa acgccgtcag
1561 aaacaccagg aatacctgaa cagtatttg caacatgcaa aagattttaa ggaatatcat
1621 cggtctgtgg ccggaaagat ccagaagctc tccaaagcag tgcaacttg gcatgccaac
1681 actgaaagag agcagaagaa ggagacagag cggattgaaa aggagagaat gcggcgactg
1741 atggctgaag atgaggaggg ttatagaaaa ctgattgatc aaaagaaaga caggcgttta
1801 gcttaccttt tgcagcagac cgatgagtat gtagccaatc tgaccaatct ggtttgggag
1861 cacaagcaag cccaggcagc caaagagaag aagaagagga ggaggaggaa gaagaaggct
1921 gaggagaatg cagagggtgg ggagtctgcc ctgggaccgg atggagagcc catagatgag
1981 agcagccaga tgagtgacct ccctgtcaaa gtgactcaca cagaaaccgg caaggttctg
2041 ttcggaccag aagcacccaa agcaagtcag ctggacgcct ggctgaaat gaatcctggt
2101 tatgaagttg cccctagatc tgacagtgaa gagagtgatt ctgattatga ggaagaggat
2161 gaggaagaag agtccagtag gcaggaaacc gaagagaaaa tactcctgga tccaaatagc
2221 gaagaagttt ctgagaagga tgctaagcag atcattgaga cagctaagca agacgtggat
2281 gatgaataca gcatgcagta cagtgccagg ggctcccagt cctactacac cgtggctcat
2341 gccatctcgg agagggtgga gaaacagtct gccctcctaa ttaatgggac cctaaagcat
2401 taccagctcc agggcctgga atggatggtt tccctgtata ataacaactt gaacggaatc
2461 ttagccgatg aaatgatgct tggaaagacc atacagacca ttgcactcat cacttatctg
2521 atggagcaca aaagactcaa tggcccctat ctcatcattg ttccccttc gactctatct
2581 aactggacat atgaatttga caaatgggct ccttctgtgg tgaagatttc ttacaagggt
2641 actcctgcca tgcgtcgctc ccttgtcccc cagctacgga gtggcaaatt caatgtcctc
2701 ttgactactt atgagtatat tataaaagac aagcacattc ttgcaaagat tcggtggaaa
2761 tacatgatag tggacgaagg ccaccgaatg aagaatcacc actgcaagct gactcaggtg
2821 gacttaaatg aagaagaaac tatattgatc atcaggcgtc tacataaggt gttaagacca
2881 ttttactaa ggagactgaa gaaagaagtt gaatcccagc ttcccgaaaa agtggaatat
2941 gtgatcaagt gtgacatgtc agctctgcag aagattctgt atcgccatat gcaagcgaag
3001 gggatccttc tcacagatgg ttctgagaaa gataagaagg ggaaggagg tgctaagaca
3061 cttatgaaca ccattatgca gttgagaaaa atctgcaacc acccatatat gttcagcac
3121 attgaggaat cctttgctga cacctaggc tattcaaatg gggtcatcaa tggggctgaa
3181 ctgtatcggg cctcaggaa gtttgagctg cttgatcgta ttctgccaaa attgagagcg
3241 actaatcacc gagtgctgct tttctgccag atgaccatct tcatgaccat catggaggat
3301 tattttgctt ttcggaactt cctttaccta cgccttgatg gcaccaccaa gtctgaagat
3361 cgtgctgctt tgctgaagaa attcaatgaa cctgatccc agtatttcat tttcttgctg
3421 agcacaagag ctggtggcct gggcttaaat cttcaggcag ctgatacagt ggtcatcttt
3481 gacagcgact ggaatcctca tcaggatctg caggcccaag accgagctca ccgcatcggg
3541 cagcagaacg aggtccgggt actgaggctc tgtaccgtga acacgcgtgga ggaaaagatc
3601 ctcgcggccg caaaatacaa gctgaacgtg gatcagaaag tgatccaggc gggcatgttt
3661 gaccaaaagt cttcaagcca cgagcggagg gcattcctgc aggccatctt ggagcatgag
3721 gaggaaaatg aggaagaaga tgaagtaccg gacgatgaga tctgaacca aatgattgct
3781 cgacgagaag aagaatttga cctttttatg cggatggaca tggaccggcg gagggaagat
3841 gcccggaacc cgaaacggaa gccccgttta atggaggagg atgagctgcc ctcctggatc
3901 attaaggatg acgctgaagt agaaaggctc acctgtgaag aagaggagga gaaatatttt
3961 gggaggggt cccgccagcc ccgtgacgtg gactacagtg acgccctcac ggagaagcag
4021 tggctaaggg ccatcgaaga cggcaatttg gaggaaatgg aagaggaagt acggcttaag
4081 aagcgaaaaa gacgaagaaa tgtggataaa gatcctgcaa aagaagatgt ggaaaagct
4141 aagaagagaa gaggccgccc tcccgctgag aaactgtcac caaatccccc caaactgaca
4201 aagcagatga acgctatcat cgatactgtg ataaactaca aagtagtc agggcgacag
4261 ctcagtgaag tcttcattca gttaccttca aggaaagaat taccagaata ctatgaatta
4321 attaggaagc cagtggattt caaaaaaata aaggaaagga ttcgtaatca taagtaccgg
4381 agcctaggcg acctggagaa ggatgtcatg cttctctgtc acaacgctca gacgttcaac
4441 ctggagggat cccagatcta tgaagactcc atcgtcttac agtcagtgtt taagagtgcc
4501 cggcagaaaa ttgccaaaga ggaagagagt gaggatgaaa gcaatgaaga gggaggaag
4561 gaagatgaag aagagtcaga gtccgaggca aaatcagtca aggtgaaaat taagctcaat
4621 aaaaaagatg acaaaggccg ggacaaaggg aaaggcaaga aaaggccaaa tcgaggaaaa
4681 gccaaacctg tagtgagcga ttttgacagc gatgaggagc aggatgaacg tgaacagtca
4741 gaaggaagtg ggacggatga tgagtgatca gtatggacct ttttccttg tagaactgaa
4801 ttccttcctc ccctgtctca tttctaccca gtgagttcat ttgtcatata ggcactgggt
4861 tgtttctata tcatcatcgt ctataaacta gctttaggat agtgccagac aaacatatga
4921 tatcatggtg taaaaaaaac acacatacac aaatatttgt aacatattgt gaccaaatgg
4981 gcctcaaaga ttcagattga aacaaacaaa aagcttttga tggaaaatat gtgggtggat
5041 agtatatttc tatgggtggg tctaatttgg taacggtttg attgtgcctg gttttatcac
5101 ctgttcagat gagaagattt ttgtcttttg tagcactgat aaccaggaga agccattaaa
5161 agccactggt tattttattt ttcatcaggc aatttcgag gtttttatt gttcggtatt
5221 gtttttac actgtggtac atataagcaa ctttaatagg tgataaatgt acagtagtta
5281 gattcacct gcatatacat ttttccattt tatgctctat gatctgaaca aaagcttttt
5341 gaattgtata agattatgt ctactgtaaa cattgcttaa tttttttgct cttgatttaa
5401 aaaaaagttt tgttgaaagc gctattgaat attgcaatct atatagtgta ttggatggct
5461 tcttttgtca ccctgatctc ctatgttacc aatgtgatc gtctccttct ccctaaagtg
5521 tacttaatct ttgctttctt tgcacaatgt ctttggttgc aagtcataag cctgaggcaa
5581 ataaaattcc agtaatttcg aagaatgtgg tgttggtgct ttcctaataa agaaataatt
5641 tagcttgaca aaaaaaaaa aaaa
```

SEQ ID NO: 78 Human BRM Amino Acid Sequence Isoform C (NP_001276326.1)
```
  1 mstptdpgam phpgpspgpg pspgpilgps pgpgpspgsv hsmmgpspgp psvshpmptm
 61 gstdfpqegm hqmhkpidgi hdkgivedih cgsmkgtgmr pphpgmgppq spmdqhsqgy
121 msphpsplga pehvsspmsg ggptppqmpp sqpgalipgd pqamsqpnrg pspfspvqlh
181 qlraqilayk mlargqplpe tlqlavggkr tlpglqqqqq qqqqqqqqq qqqqqqqpq
```

TABLE 1-continued

```
 241 qqppqpqtqq qqqpalvnyn rpsgpgpels gpstpqklpv papggrpspa ppaaaqppaa
 301 avpgpsvpqp apgqpspvlq lqqkqsrisp iqkpqgldpv eilqereyrl qariahriqe
 361 lenlpgslpp dlrtkatvel kalrllnfqr qlrqevvacm rrdttletal nskaykrskr
 421 qtlrearmte klekqqkieq erkrrqkhqe ylnsilqhak dfkeyhrsva gkiqklskav
 481 atwhantere qkketeriek ermrrlmaed eegyrklidq kkdrrlayll qqtdeyvanl
 541 tnlvwehkqa qaakekkkrr rrkkkaeena eggesalgpd gepidessqm sdlpvkvtht
 601 etgkvlfgpe apkasqldaw lemnpgyeva prsdseesds dyeeedeeee ssrqeteeki
 661 lldpnseevs ekdakqiiet akqdvddeys mqysargsqs yytvahaise rvekqsalli
 721 ngtlkhyqlq glewmvslyn nnlngilade mglgktiqti alitylmehk rlngpyliiv
 781 plstlsnwty efdkwapsvv kisykgtpam rrslvpqlrs gkfnvlltty eyiikdkhil
 841 akirwkymiv deghrmknhh ckltqvdlne eetiliirrl hkvlrpfllr rlkkevesql
 901 pekveyvikc dmsalqkily rhmqakgill tdgsekdkkg kggaktlmnt imqlrkicnh
 961 pymfqhiees faehlgysng vingaelyra sgkfelldri lpklratnhr vllfcqmtsl
1021 mtimedyfaf rnflylrldg ttksedraal lkkfnepgsq yfifllstra gglglnlqaa
1081 dtvvifdsdw nphqdlqaqd rahrigqqne vrvlrlctvn sveekilaaa kyklnvdqkv
1141 iqagmfdqks ssherraflq aileheeene eedevpddet lnqmiarree efdlfmrmdm
1201 drrredarnp krkprlmeed elpswiikdd aeverltcee eeekifgrgs rqrrdvdysd
1261 altekqwlra iedgnleeme eevrlkkrkr rrnvdkdpak edvekakkrr grppaekisp
1321 nppkltkqmn aiidtvinyk dssgrqlsev fiqlpsrkel peyyelirkp vdfkkikeri
1381 rnhkyrslgd lekdvmllch naqtfnlegs qiyedsivlq svfksarqki akeeesedes
1441 neeeeeedee eseseaksvk vkiklnkkdd kgrdkgkgkk rpnrgkakpv vsdfdsdeeq
1501 dereqsegsg tdde
```

SEQ ID NO: 79 Human BRM cDNA Sequence Variant 5 (NM_001289398.1, CDS: from 203 to 949)

```
   1 cttggagagg cggaggtgga aacgatgcgc aggagttggc ttggggcttt ttgtttgcgt
  61 gtccctgttt acctattcat aatcatggat cccctctgct ttgtgatact gtgaaccacg
 121 cataacagca attctttaca ccaccgggtt gagaagaagg cgcctgaggc tgactttctg
 181 gacctgccgt cacgcagtaa agatgtggtt ggccatcgaa gacggcaatt tggaggaaat
 241 ggaagaggaa gtacggctta agaagcgaaa aagacgaaga aatgtggata aagatcctgc
 301 aaaagaagat gtggaaaaag ctaagaagag aagaggccgc cctcccgctg agaaactgtc
 361 accaaatccc ccaaactga caaagcagat gaacgctatc atcgatactg tataaacta
 421 caaagatagt tcagggcgac agctcagtga agtcttcatt cagttacctt caaggaaaga
 481 attaccagaa tactatgaat taattaggaa gccagtgaat ttcaaaaaaa taaaggaaag
 541 gattcgtaat cataagtacc ggagcctagg cgacctggag aaggatgtca tgcttctctg
 601 tcacaacgct cagacgttca acctggaggg atcccagatc tatgaagact ccatcgtctt
 661 acagtcagtg tttaagagtc cccggcagaa aattgccaaa gaggaagaga gtgaggatga
 721 aagcaatgaa gaggaggaag aggaagatga aaagagtca gagtccgagg caaaatcagt
 781 caaggtgaaa attaagctca ataaaaaaga tgacaaaggc cgggacaaag ggaaaggcaa
 841 gaaaaggcca aatcgaggaa aagccaaacc tgtagtgagc gattttgaca gcgatgagga
 901 gcaggatgaa cgtgaacagt cagaaggaag tgggacggat gatgagtgat cagtatggac
 961 cttttccctt ggtagaactg aattccttcc tccccctgtc catttctacc cagtgagttc
1021 atttgtcata taggcactgg gttgtttcta tatcatcatc gtctataaac tagctttagg
1081 atagtgccag acaaacatat gatatcatgg tgtaaaaaac acacacatac acaaatattt
1141 gtaacatatt gtgaccaaat gggcctcaaa gattcagatt gaaacaaaca aaaagctttt
1201 gatggaaaat atgtgggtgg atagtatatt tctatgtatt ggtctaattt ggtaacggtt
1261 tgattgtgcc tggttttatc acctgttcag atgaagagat ttttgtcttt tgtagcactg
1321 ataaccagga gaagccatta aaagccactg gttatttat tttttcatcag gcaatttcg
1381 aggtttttat ttgttcggta ttgtttttt acactgtggt acatataagc aactttaata
1441 ggtgataaat gtacagtagt tagatttcac ctgcatatac atttttccat tttatgctct
1501 atgatctgaa caaaagcttt ttgaattgta taagatttat gtctactgta aacattgctt
1561 aattttttg ctctcgattt aaaaaaaagt tttgttgaaa gcgctattga atattgcaat
1621 ctatatagtg tattggatgg cttctttgt caccctgatc tcctatgtta ccaatgtgta
1681 tcgtctcctt ctccctaaag tgtacttaat ctttgcttt tttgcacaat gtctttggtt
1741 gcaagtcata agcctgaggc aaataaaatt ccagtaattt cgaagaatgt ggtgttggtg
1801 ctttcctaat aaagaaataa tttagcttga caaaaaaaaa aaaaa
```

SEQ ID NO: 80 Human BRM Amino Acid Sequence Isoform D (NP_001276327.1)

```
   1 mwlaiedgnl eemeeeevrlk krkrrrnvdk dpakedveka kkrrgrppae klspnppklt
  61 kqmnaiidtv inykdssgrq lsevfiqlps rkelpeyyel irkpvdfkki kerirnhkyr
 121 slgdlekdvm llchnaqtfn legsqiyeds ivlqsvfksa rqkiakeees edesneeeee
 181 edeeeesea ksvkvkikln kkddkgrdkg kgkkrpnrgk akpvvsdfds deeqdereqs
 241 egsgtdde
```

SEQ ID NO: 81 Human BRM cDNA Sequence Variant 6 (NM_001289399.1, CDS: from 106 to 936)

```
   1 attcacttca ttaaatctag aggcagttga gcatgggagc cgtctgtatg ttgaattagg
  61 gctcgcactc ttgcgcaaca cgtcaccagt cggaaactgg ggctgatgaa gagactagca
 121 gctcgctgct ttgctggctt gttaatttta tccccactaa ctgtgatttc tgatagccgg
 181 cctgctgata gtggtaaggc catcgaagac ggcaatttgg aggaaatgga agaggaagta
 241 cggcttaaga agcgaaaaag acgaagaaat gtggataaag atcctgcaaa agaagatgt
 301 gaaaaagcta agaagaaag aggccgccct cccgctgaga aactgtcacc aaatcccccc
 361 aaactgacaa agcagatgaa cgctatcatc gatactgtga taaactacaa agatagttca
 421 gggcgacagc tcagtgaagt cttcattcag ttaccttcaa ggaaagaatt accagaatac
 481 tatgaattaa ttaggaagcc agtgaattc aaaaaataa aggaaaggat tcgtaatcat
 541 aagtaccgga gcctaggcga cctggagaag gatgtcatgc ttctctgtca caacgctcag
 601 acgttcaacc tggagggatc ccagatctat gaagactcca tcgtcttaca gtcagtgttt
 661 aagagtgccc ggcagaaaat tgccaaagag gaagagtg aggatgaaag caatgaagag
 721 gaggaagagg aagatgaaga agagtcagag tccgaggcaa aatcagtcaa ggtgaaaatt
 781 aagctcaata aaaaagatga caaaggccgg gacaaaggga aaggcaagaa aaggccaaat
```

TABLE 1-continued

```
 841 cgaggaaaag ccaaacctgt agtgagcgat tttgacagcg atgaggagca ggatgaacgt
 901 gaacagtcag aaggaagtgg gacggatgat gagtgatcag tacggacctt tttccttggt
 961 agaactgaat tccttcctcc cctgtctcat ttctacccag tgagttcatt tgtcatatag
1021 gcactgggtt gtttctatat catcatcgtc tataaactag ctttaggata gtgccagaca
1081 aacacatgat atcatggtgt aaaaaacaca cacatacaca aacatttgta acatattgtg
1141 accaaatggg cctcaaagat tcagattgaa acaaacaaaa agcttttgat ggaaaatatg
1201 tgggtggata gtatatttct atgggtgggt ctaatttggt aacggtttga ttgtgcctgg
1261 ttttatcacc tgttcagatg agaagatttt tgtcttttgt agcactgata accaggagaa
1321 gccattaaaa gccactggtt attttatttt tcatcaggca attttcgagg ttttattttg
1381 ttcggtattg tttttttaca ctgtggtaca tataagcaac tttaataggt gataaatgta
1441 cagtagttag atttcacctg catatacatt tttccatttt atgctctatg atctgaacaa
1501 aagctttttg aattgtataa gatttatgtc tactgtaaac attgcttaat ttttttgctc
1561 ttgatttaaa aaaaagtttt gttgaaagcg ctattgctcta ttgcaatcta tatagtgtat
1621 tggatggctt cttttgtcac cctgatctcc tatgttacca acgtgtatcg tctccttctc
1681 cctaaagtgt acttaatctt tgctttcttt gcacaatgtc tttggttgca agtcataagc
1741 ctgaggcaaa taaaattcca gtaatttcga agaatgtggt gttggtgctt tcctaataaa
1801 gaaataattt agcttgacaa aaaaaaaaaa aaa
```

SEQ ID NO: 82 Human BRM Amino Acid Sequence Isoform E (NP_001276328.1)
```
   1 mkrlaarcfa gllilspltv isdsrpadsg kaiedgnlee meeevrlkkr krrrnvdkdp
  61 akedvekakk rrgrppaekl spnppkltkq mnaiidtvin ykdssgrqls evfiqlpsrk
 121 elpeyyelir kpvdfkkike rirnhkyrsl gdlekdvmll chnaqtfnle gsqiyedsiv
 181 lqsvfksarq kiakeeesed esneeeeeed eeeseseaks vkvkiklnkk ddkgrdkgkg
 241 kkrpnrgkak pvvsdfdsde eqdereqseg sgtdde
```

SEQ ID NO: 83 Human BRM cDNA Sequence Variant 7 (NM_001289400.1, CDS: from 521 to 1357)
```
   1 acttcattaa atctagaggc agttgagcat gggagccgtc tgtatgttga attagggctc
  61 gcactcttgc gcaacacgtc accagtcgga aactgggggt tcgcttctgt gatttatttc
 121 attattgtgc tggtaaaagg tttggaaggg aattccttt gggggtagta cttttagcatt
 181 gtgtagcaag ttttggggtt ttttcgtgt gtgacccccc agcccccagc gctgagtttg
 241 agtcagttga gccagtttag taaataattt tttaaaataa agaacagtt taaaatctcc
 301 atgaacaatt ttacttacat gcaggagtaa tcctactcta ctctttacgt gcgaaaagea
 361 ttgggaagtg tttagtgaat tgatttccat tagaaaaaga ccctagaaa tcacagaaca
 421 taaagcactg catatggatg tgtttggggt cttttgggag gagggaagat gttttgtagc
 481 tctctgcatt cctgcataaa accttagttt gaggggaata atgctgatga agagactagc
 541 agctcgctgc tttgctggct tgttaatttt atccccacta actgtgattt ctgatagccg
 601 gcctgctgat agtggtaagg ccatcgaaga cggcaatttg gaggaaatgg aagaggaagt
 661 acggcttaag aagcgaaaaa gacgaagaaa tgtggataaa gaccctgcaa agaagatgt
 721 ggaaaaagct aagaagagaa gaggccgccc tccgctgag aaactgtcac caaatcccc
 781 caaactgaca aagcagatga acgctatcat cgatactgtg ataaactaca agatagttc
 841 agggcgacag ccagtgaag tcttcattca gttaccttca aggaaagaat taccagaata
 901 ctatgaatta attaggaagc cagtggattt caaaaaaata aaggaaagga ttcgtaatca
 961 taagtaccgg agcctaggcg acctggagaa ggatgtcatg cttctctgtc acaacgctca
1021 gacgttcaac ctggagggat cccagatcta tgaagactcc atcgtcttac agtcagtgtt
1081 caagagtgcc cggcagaaaa ttgccaaaga gaaggagat gaggatgaaa gcaatgaaga
1141 ggaggaagag gaagatgaag aagagtcaga gtccgaggca aaatcagtca aggtgaaaat
1201 taagctcaat aaaaaagatg acaaaggccg ggacaaaggg aaaggcaaga aaaggccaaa
1261 tcgaggaaaa gccaaacctg tagtgagcga ttttgacagc gatgaggagc aggatgaacg
1321 tgaacagtca gaaggaagtg ggacggatga tgagtgatca gtatggacct tttttccttgg
1381 tagaactgaa ttccttcctc cctgtctca tttctaccca gtgagttcat ttgtcatata
1441 ggcactgggt tgtttctata tcatcatcgt ctataaacta gctttaggat agtgccagac
1501 aaacatatga tatcatggtg taaaaaacac acacatacac aaatatttgt aacatattgt
1561 gaccaaatgg gcctcaaaga ttcagattga aacaaacaaa aagcttttga tggaaaatat
1621 gtgggtggat agtatatttc tatgggtggg tctaatttgg taacggtttg attgtgcctg
1681 gttttatcac ctgttcagat gagaagattt ttgtcttttg tagcactgat aaccaggaga
1741 agccattaaa agccactggt tattttattt tccatcaggc aattttcgag gttttatttt
1801 gttcggtatt gtttttttac actgtggtac atataagcaa ctttaatagg tgataaatgt
1861 acagtagtta gatttcacct gcatatacat tttccatttt atgctctat gatctgaaca
1921 aaagcttttt gaattgtata agatttatgt ctactgtaaa cattgcttaa ttttttgct
1981 cttgatttaa aaaaagttt tgttgaaagc gctattgaat attgcaatct atatagtgta
2041 ttggatggct tcttttgtca ccctgatctc ctatgttacc aatgtgtatc gtctccttct
2101 ccctaaagtg tacttaatct ttgctttctt tgcacaatgt ctttggttgc aagtcataag
2161 cctgaggcaa ataaaattcc agtaatttcg aagaatgtgg tgttggtgct ttcctaataa
2221 agaaataatt tagcttgaca aaaaaaaaaa aaaa
```

SEQ ID NO: 84 Human BRM Amino Acid Sequence Isoform F (NP_001276329.1)
```
   1 mlmkrlaarc fagllilspl tvisdsrpad sgkaiedgnl eemeeevrlk krkrrrnvdk
  61 dpakedveka kkrrgrppae klspnppklt kqmnaiidtv inykdssgrq lsevfiqlps
 121 rkelpeyyel irkpvdfkki kerirnhkyr slgdlekdvm llchnaqtfn legsqiyeds
 181 ivlqsvfksa rqkiakeees edesneeeee edeeesesea ksvkvkikln kkddkgrdkg
 241 kgkkrpnrgk akpvvsdfds deeqdereqs egsgtdde
```

SEQ ID NO: 85 Mouse BRM cDNA Sequence Variant 1 (NM_011416.2, CDS: from 111 to 4862)
```
   1 ctcgcccct ctgtttctgt acttgggtg actcagagag ggaagattca gccagcacac
  61 tgctcgcgag caagtgtcac tctgctaact ggcagagcca ggagaccta g atgtccacac
 121 ccacagaccc agcagcaatg cccatcctg ggccctccc ggggcctgga ccctctcctg
 181 gaccaattct ggggcctagt ccaggaccag gaccatccc aggttctgtg cacagcatga
 241 tgggtcctag tcccggaacct cccagcgtct cacatcctct gtcaacgatg ggctctgcag
```

TABLE 1-continued

```
 301 acttcccaca ggaaggcatg caccaattac ataagcccat ggatgggata catgacaaag
 361 ggattgtaga agatgtccac tgtggatcca tgaagggcac cagcatgcgc cccccacacc
 421 caggaatggg ccctccacag agcccatgg accagcacag ccaaggttat atgtcaccac
 481 atccgtctcc tctgggagcc ccggagcacg tctctagccc tatatctgga ggaggcccaa
 541 ccccacccca gatgccaccg agccagccag gggcactcat cccaggagat ccgcaggcca
 601 tgaaccagcc taacagaggt ccctcgcctt tcagtcctgt gcagctgcat cagcttcgag
 661 ctcagatttt agcttacaaa atgttggcca ggggccagcc tctccccgaa actctgcagc
 721 tggcagtcca gggaaaaagg accttgcctg gcatgcagca gcagcagcag caacaacaac
 781 aacagcagca gcagcagcag cagcagcagc agcaacagca gcaacaacag cagcccagc
 841 agcctcagca gcaggtcag gcacagcccc agcagcagca gcaacagcag cagcagccag
 901 ctcttgttag ctataatcga ccatctggcc ccgggcagga gctgctactg agtggccaga
 961 gcgctccgca gaagctgtca gcaccagcac caagcggccg accttcaccg gcaccccagg
1021 ccgccgtcca gcccacggcc acagcggtgc ccgggccctc cgtgcagcag cccgcccag
1081 ggcagccgtc tccggtccta cagctgcaac agaagcgag ccgcatcagc cccatccaga
1141 aaccgcaagg cctggacccg gtggagatcc tgcaggaacg agagtacaga cttcaagctc
1201 gcatcgctca taggatacaa gaactggaaa gtctgcctgg ttccttgcca ccagatttac
1261 gcaccaaagc aaccgtggaa ctgaaagcac ttcgcttact caacttccaa cgtcagctga
1321 gacaggaggt ggtggcctgc atgcggaggg acaccaccct ggagacggcc ctcaactcca
1381 aagcatataa gcggagcaag cgccagaccc tgcgtgaggc acgcatgaca gagaaactgg
1441 agaagcagca gaagatagaa caggagagga aacgccggca gaaacaccag gaatacctga
1501 acagtatttt gcaacatgca aaagattta aggaaatatca ccggtctgtg gccgggaaga
1561 tccagaagct ctccaaagca gtggcgactt ggcatgctaa cacagaaagg gagcagaaga
1621 aggagacgga gcggatcgag aaggcgagaa tgcggaggct gatggccgaa gatgaagagg
1681 gctacaggaa gcttattgac caaaagaaag acagacgtct cgcctaccta ttgcagcaga
1741 ccgatgagta tgtcgccaat ctgaccaacc tggtgtggga gcacaagcag gcccaagcag
1801 ccaaagagaa gaagaagagg aggaggagga agaagaaggc tgaagagaat gcagagggag
1861 gggaacctgc cctgggacca gatggagagc caatagatga aagcagccag atgagtgacc
1921 tgcctgccaa agtgacacac acagaaactg gcaaggtcct ctttggacca gaagcaccca
1981 aagcaagtca gctggatgcc tggctggaga tgaatcctgg ttacgaagtt gcacccagat
2041 ctgacagtga agagagtgaa tcggactacg aggaggagga tgaagaagaa gagtccagta
2101 ggcaggaaac cgaggagaag atactgctgg atcccaacag tgaagaagtt tccgaaaagg
2161 atgccaagca gatcattgag actgcgaagc aggacgtgga cgacgaatac agcatgcagt
2221 acagtgccag aggctctcag tcctactaca cggtggctca cgctatctct gagagggtgg
2281 agaagcagtc tgccctcctc attaacggca ccctaaagca ttaccagctc aggggcctga
2341 aatggatggt ttccctgtat aataacaatc tgaacggaat cttagctgat gaaatggggc
2401 taggcaagac catccagacc attgcactca tcacgtatct gatggagcac aaaaggctca
2461 atggtcccta cctcatcatc gtcccctct cgactctgtc taactggaca tatgaatttg
2521 acaaatgggc tccttctgtg gtgaaaattt cttacaaggg taccctgcc atgcgacgct
2581 ccctcgttcc ccagctacgg agtggcaaat tcaatgtccc cctgactact tacgagtaca
2641 ttataaaaga caagcacatt cttgcaaaga ttcggtggaa gtacatgatc gtggacgaag
2701 gccaccggat gaagaatcac cactgcaagc taacccaggt cctgaacaca cactatgtgg
2761 ccccaggcg gatccttctg actgggaccc cactgcagaa taagcttccg gaactctgag
2821 ccctcctcaa cttcctcctc cctacaatct tcaagagttg cagcacattt gagcagtggt
2881 ttaatgctcc atttgccatg accggtgaaa gggtggaccct gaacgaagaa gaaacgattt
2941 tgatcatcag gcgtctacac aaggtgctga gacccttttt actgaggagg ctgaagaaag
3001 aggttgagtc tcagcttccg gaaaaggttg agtatgtgat caagtgtgac atgtcagctc
3061 tgcagaagat tctgtaccgt cacatgcaag ccaaggggat cctcctcacg gacgggtctg
3121 agaaagataa gaaggggaaa ggaggtgcca agacacttat gaacaccatc atgcagctga
3181 gaaaaatatg caaccaccca tatatgtttc agcacattga ggaatccttt gctgaacacc
3241 tgggctattc gaatgggtc atcaatgggg ctgagctgta tcgggcctcg ggaaagtttg
3301 agctgctcga tcgcattctg cccaaattga gagcgactaa ccaccgcgtg ctgcttttct
3361 gccagatgac gtcactcatg accattatgg aggattactt tgcttttcgg aacttcctgt
3421 acctgcgcct tgacggcacc accaagtctg aagatcgtgc tgctttgcta aagaaattca
3481 atgaacctgg gtcccagtat ttcatttct tgctgagcac aagagcaggg ggctgggct
3541 taaatcttca ggcggcagac acggtggtca tatttgacag cgactggaat cctcaccagg
3601 atctgcaggc ccaagaccga gctcaccgca ttggccaaca aaacgaggtc cggggtgctga
3661 ggctttgcac cgtcaacagt gtggaggaaa agattctcgc ggctgccaag tacaagctga
3721 acgtggatca gaaggttatc caagcaggca tgtttgacca gaagtcatcc agccacgagc
3781 ggagggcctt cctgcaggcc attctggagc acgaggagga gaatgagaa gaagatgagg
3841 taccagacga cgagaccctg aaccagatga ttgctcgccc ggaggaagaa tttgatcttt
3901 ttatgcgcat ggacatggac cggcggaggg aggatgcccg gaacccgaag cgcaaccccc
3961 gcttgatgga ggaagatgag ctgcccctcct ggattatcaa ggatgacgcc gaagtggaaa
4021 ggctcacctg tgaagaagga gaggagaaga tatttgggag gggctctcgc cagcgccggg
4081 atgtggacta cagtgatgcc ctcaccgaga agcaatggct cagggccatc gaagacggca
4141 atttggaaga aatgaaagag gaggtacggc ttaagaagag aaaaagacga agaaatgtgg
4201 ataaagaccc cgtgaaggaa gatgtggaaa aagcgaagaa aagaagaggc cgccctccgg
4261 ctgagaagtt gtcaccaaat ccccccaaac taaccagcca gatgaacgcc atcattgata
4321 ctgtgataaa ctacaaagac agttcagggc gacagctcag tgaagtcttc attcagttac
4381 cttccaggaa agacttacca gaatactatg aattaattag gaagccagtg gatttcaaaa
4441 agataaaagga gcgaatccgt aaccataagt atcggagcct gggagacctg gagaaagacg
4501 tcatgcttct ctgtcacaac gcacagacat tcaacttgga aggatcccag atctacgaag
4561 actccattgt cctacagtca gtgtttaaga gtgctcggca gaaaattgcc aaagaagaag
4621 agagtgagga agaaagcaat gaagaagagg aagaagatga tgaaggaggag tcggagtcag
4681 aggcgaaatc tgtgaaggtg aaaatcaagc tgaataaaaa ggaagagaaa ggccgggaca
4741 cagggaaggg caagaagcgg ccaaaccgag gcaaagccaa acccgtcgtg agcgattttg
4801 acagtgacga ggaacaggaa gagaacgaac agtcagaagc aagtggaact gataacgagt
4861 gaccatcctg gacgtgagct tcccgcggtg gcagaaccga atgctttcct ccccctctcc
4921 ttcctcccca gtgagttcac ttgccattcg ggcacactgg gttattctc cgtcctcatt
4981 gtcatctaga actagcttta gggtagtgcc agacaaacat atgatatcat ggtgtaaaaa
5041 aagaaacaca tgcgtgcaga cacactacac acacacacac acacacacac acacacacac
```

TABLE 1-continued

```
5101 acacatattt gtaacatatt gtgaccaaat gggcctcaaa gattcaaaga ttaaaaacaa
5161 aaagcttttg atggaaaaga tgtgggtgga tagtatattt ctacaggtgg gtcaggtttg
5221 gtagcagttt gatgtgctgg gttctgtcat ctgttctgat gagaagattt ttatcttctg
5281 cagtgctgat ggccgggagg aaccattcaa agccactggt tattttgttt ttcatcaggc
5341 gattttcaag attttcattt gtttcagtat tgttggtttt ctctttcctc tttttacac
5401 tgtggtacat aaagcaact tgactagtga caaatgtaca gtagttagat atcacctaca
5461 tatacatttt tccattttat gctctatgat ctgaagaaca aaaaaaaaag cttttttgact
5521 tgtataagat ttatgtctac tgtaaacatt gcggaatttt tttttgttct tgttttattg
5581 acaatgctat tgagtattac agtgtctaga ataccctgga tggcttctct tgtccacccg
5641 atctcccgtg ttaccaatgt gtatggtctc cttctcccga aagtgtactt aatctttgct
5701 ttctttgcac aatgtctttg gttgcaagtc ataagcctga ggcaaataaa attccagtaa
5761 tttccaagaa tgtggtgttg gtactttcct aataaaccga taacgtacct tgaaaaaaaa
5821 aaaaaaaaa a
```

SEQ ID NO: 86 Mouse BRM Amino Acid Sequence Isoform A (NP_035546.2)

```
    1 mstptdpaam phpgpspgpg pspgpilgps pgpgpspgpg psvshplstm
   61 gsadfpqegm hqlhkpmdgi hdkgivedvh cgsmkgtsmr pphpgmgppq spmdqhsqgy
  121 msphpsplga pehvsspisg ggptppqmpp sqpgalipgd pqamnqpnrg pspfspvqlh
  181 qlraqilayk mlargqplpe tlqlavqgkr tlpgmqqqqq qqqqqqqqq qqqqqqqqq
  241 qpqqpqqqaq aqpqqqqqqq qqpalvsynr psgpgqelll sgqsapqkls apapsgrpsp
  301 apqaavqpta tavpgpsvqq papgqpspvl qlqqkqsris piqkpqgldp veilqereyr
  361 lqariahriq eleslpgslp pdlrtkatve lkalrllnfq rqlcqevvac mrrdttleta
  421 lnskaykrsk rqtlrearmt eklekqqkie qerkrrqkhq eylnsilqha kdfkeyhrsv
  401 agkiqklska vatwhanter eqkketerie kermrrlmae deegyrklid qkkdrrlayl
  541 lqqtdeyvan ltnlvwehkq aqaakekkkr rrrkkkaeen aeggepalgp dgepidessq
  601 msdlpvkvth tetgkvlfgp eapkasqlda wlemnpgyev aprsdseese sdyeeedeee
  661 essrqeteek illdpnseev sekdakqiie takqdvddey smqysargsq syytvahais
  721 ervekqsall ingtlkhyql qglewmvsly nnnlngilad emglgktiqt iality1meh
  781 krlngpylii vplstlsnwt yefdkwapsv vkisykgtpa mrrslvpqlr sgkfnvlltt
  841 yeyiikdkhi lakirwkymi vdeghrmknh hckltqvlnt hyvaprrill tgtplqnklp
  901 elwallnfll ptifkscstf eqwfnapfam tgervdlnee etiliirrlh kvlrpfllrr
  961 lkkevesqlp ekveyvikcd msalqkilyr hmqakgillt dgsekdkkgk ggaktlmnti
 1021 mqlrkicnhp ymfqhieesf aehlgysngv ingaelyras gkfelldril pklratnhrv
 1081 llfcqmtslm timedyfafr nflylrldgt tksedraall kkfnepgsqy fifllstrag
 1141 glglnlqaad tvvifdsdwn phqdlqaqdr ahrigqqnev rvlrlctvns veekilaaak
 1201 yklnvdqkvi qagmfdqkss sherraflqa ileheeenee edevpddetl nqmiarreee
 1261 fdlfmrmdmd rrredarnpk rkprlmeede lpswiikdda everltceee eekifgrgsr
 1321 qrrdvdysda lrekqwlrai edgnleemee evrlkkrkrr rnvdkdpvke dvekakkrrg
 1381 rppaeklspn ppkltkqmna iidtvinykd ssgrqlsevf iqlpsrkdlp eyyelirkpv
 1441 dfkkikerir nhkyrslgdl ekdvmllchn aqtfnlegsq iyedsivlqs vfksarqkia
 1501 keeeseeesn eeeeeddeee seseaksvkv kiklnkkeek grdtgkgkkr pnrgkakpvv
 1561 sdfdsdeeqe eneqseasgt dne
```

SEQ ID NO: 87 Mouse BRM cDNA Sequence Variant 2 (NM_026003.2, CDS: from 301 to 1011)

```
    1 ttcacctcat taaatctaga ggcggttcag catgggagcc gtctgtatgt tgaattaggg
   61 ctcgctctct tgcgcaacac gtcaccagtc ggaaactggg ggtttgcttc tgtgatttat
  121 ttcattattg tgctggtaaa agctgatgaa gagactagca gctcgctgct ttgccggctt
  181 gttaattta tccccactaa ctgtgatttc cgatagccgg cctgctgata gtggtaagtg
  241 cggctggctc tggtttaaag caagcgtttg caggccatcg aagacggcaa tttggaagaa
  301 atggaagagg aggtacggct taagaagaga aaaagacgaa gaaatgtgga taaagacccc
  361 gtgaaggaag atgtggaaaa agcgaagaaa agaagaggcc gccctccggc tgagaagttg
  421 tcaccaaatc ccccaaaact aacgaagcag atgaacgaca tcattgatac tgtgataaac
  481 tacaaagaca gttcagggcg acagctcagt gaagtcttca ttcagttacc ttccaggaaa
  541 gacttaccag aatactatga attaattagg aagccagtgg atttcaaaaa gataaaggag
  601 cgaatccgta atcataagta tcggagcctg ggagacctgg agaaagacgt catgcttctc
  661 tgtcacaacg cacagacatt caacttggaa ggatcccaga tctacgaaga ctccattgtc
  721 ctacagtcag tgtttaagag tgctcggcag aaaattgcca agaagaaga gagtgaggaa
  781 gaaagcaatg aagaagagga agaagatgat gaagaggagt cggagtcaga ggcgaaatct
  841 gtgaaggtga aaatcaagct gaataaaaag gaggaaaag gccgggacac aggggaagggc
  901 aagaagcggc caaaccgagg caaagccaaa cccgtcgtga gcgattttga cagtgacgag
  961 gaacaggaag agaacgaaca gtcagaagca agtggaactg ataacgagtg accatcctgg
 1021 acgtgagctt ccgcgcgtgg cagaaccgaa tgctttcttc cccctctcct tcctcccag
 1081 tgagttcact tgccattcgg gcacactggg ttattctcc gtcctcattg tcatctagaa
 1141 ctagctttag ggtagtgcca gacaaacata tgatatcatg gtgtaaaaaa agaaacacat
 1201 gcgtgcagac acactacaca cacacacaca cacacacaca cacacacaca cacatatttg
 1261 taacatattg gtgaccaaatg ggcctcaaaa attcaaagat taaaacaaa aagcttttga
 1321 tggaaaagat gtgggtggat agtatatttc tacaggtggg tcaggtttgg tagcagtttt
 1381 atgtgctggg ttctgtcatc tgttctgatg agaagatttt tatcttctgc agtgctgatg
 1441 gccgggagga accattcaaa gccactggtt attttgtttt tcatcaggcg attttcaaga
 1501 ttttcatttg tttcagtatt gttggttttc tctttcctct tttttacact gtggtacata
 1561 taagcaactt gactagtgac aaatgtacag tagttagata tcacctacat atacattttt
 1621 ccattttatg ctctatgatc tgaagaacaa aaaaaaagc ttttttgactt gtataagatt
 1681 tatgtctact gtaaacattg cggaattttt ttttgttctt gttttattga caatgctatt
```

TABLE 1-continued

```
1741 gagtattaca gtgtctagaa taccctggat ggcttctctt gtccaccga tctcccgtgt
1801 taccaatgtg tatggtctcc ttctcccgaa agtgtactta atctttgctt tctttgcaca
1861 atgtctttgg ttgcaagtca taagcctgag caaataaaa ttccagtaat ttccaagaat
1921 gtggtgttgg tactttccta ataaaccgat aacgtacctt gaaa
```

SEQ ID NO: 88 Mouse BRM Amino Acid Sequence Isoform B (NP_080279.1)

```
  1 meeevrlkkr krrrnvdkdp vkedvekakk rrgrppaekl spnppkltkq mnaiidtvin
 61 ykdssgrqls evfiqlpsrk dlpeyyelir kpvdfkkike rirnhkyrsl gdlekdvmll
121 chnaqtfnle gsqiyedsiv lqsvfksarq kiakeeesee esneeeeedd eeeseseaks
181 vkvkiklnkk eekgrdtgkg kkrpnrgkak pvvsdfdsde eqeenqsea sgtdne
```

SEQ ID NO: 89 Mouse BRM cDNA Sequence Variant 3 (NM_001347439.1, CDS: from 180 to 1010)

```
   1 acacacacac acacacacac acgcaggctg aagtatgctt aactctttta acttggctgg
  61 ggcttttag caccatatgg gttctttcgt gacgtccgga cccgaaagag tgcagtgtgc
 121 ctttaaggaa agaggtacct caccaaactt ccctgtagtt gtgcctcacc atttagctga
 181 tgaagagact agcagctcgc tgctttgccg gcttgttaat tttatcccca ctaactgtga
 241 tttccgatag ccggcctgct gatagtggta aggccatcga agacggcaat ttggaagaaa
 301 tggaagagga ggtacggctt aagaagagaa aaagacgaag aaatgtggat aaagaccccg
 361 tgaaggaaga tgtgaaaaa gcgaagaaaa gaagaggccg ccctccggct gagaagttgt
 421 caccaaatcc ccaaaacta acgaagcaga tgaacgccat cattgatact gtgataaact
 481 acaaagacag ttcaggggca cagctcagtg aagtcttcat tcagttacct tccaggaaag
 541 acttaccaga atactatgaa ttaattagga agccagtgga tttcaaaaag ataaaggagc
 601 gaatccgtaa tcataagtat cggagcctgg agacctgga aaagacgtc atgcttctct
 661 gtcacaacgc acagacattc aacttggaag gatcccagat ctacgaagac tccattgtcc
 721 tacagtcagt gtttaagagt gctcggcaga aaattgccaa agaagaagag agtgaggaag
 781 aaagcaatga agaagaggaa gaagatgatg aagaggagtc ggagtcagag gcgaaatctg
 841 tgaaggtgaa aaccaagctg aataaaaagg aagagaaagg ccgggacaca gggaagggca
 901 agaagcggcc aaaccgagc aaagccaaac ccgtcgtgag cgattttgac agtgacgagg
 961 aacaggaaga gaacgaaacag tcagaagcaa gtggaactga taacgagtga ccatcctgga
1021 cgtgagcttc cgcggtggc agaaccgaat gctttcttcc ccctctcctt cctccccagt
1081 gagttcactt gccattcggg cacactgggt tattcctccg tcctcattgt catctagaac
1141 tagctttagg gtagtgccaa acaaacatat gatatcatgg tgtaaaaaa gaaacacatg
1201 cgtgcagaca cactacacac acacacacac acacacacac acatatttgt
1261 aacatattgt gaccaaatgg gcctcaaaga ttcaaagatt aaaaacaaaa agcttttgat
1321 ggaaaagatg tgggtggata gtatatttct acaggtgggg caggtttggt agcagtttga
1381 tgtgctgggt tctgtcatct gttctgatga aagatttt atcttctgca gtgctgatgg
1441 ccgggaggaa ccattcaaag ccactggtta ttttgttttt catcaggcga ttttcaagat
1501 tttcatttgt ttcagtattg ttggttttct cttttctctt ttttacactg tggtacatat
1561 aagcaacttg actagtgaca aatgtacagt agttagatat cacctacata tacatttttc
1621 catttatgc tctatgatct gaagaacaaa aaaaaagct ttttgacttg tataagattt
1681 atgtctactg taaacattgc ggaattttct tttgttcttg tttttattgac aatgctattg
1741 agtattcag tgtctagaat accctggatg gcttcccttg tccacccgat ctcccgtgtt
1801 accaatgtgt atggtctcct tctcccgaaa gtgtacttaa tctttgcttt ctttgcacaa
1861 tgtctttggt tgcaagtcat aagcctgagg caaataaaat tccagtaatt tccaagaatg
1921 tggtgttggt actttcctaa taaccgata acgtaccttg aaaaaaaaaa aaaaaaaa
```

SEQ ID NO: 90 Mouse BRM Amino Acid Sequence Isoform C (NP_001334368.1)

```
  1 mkrlaarcfa gllilspltv isdsrpadsg kaiedgnlee meeevrlkkr krrrnvdkdp
 61 vkedvekakk rrgrppaekl spnppkltkq mnaiidtvin ykdssgrqls evfiqlpsrk
121 dlpeyyelir kpvdfkkike rirnhkyrsl gdlekdvnll chnaqtfnle gsqiyedsiv
181 lqsvfksarq kiakeeesee esneeeeedd eeeseseaks vkvkiklnkk eekgrdtgkg
241 kkrpnrgkak pvvsdfdsdc eqeenqsea sgtdne
```

SEQ ID NO: 91 Human EGFR cDNA Sequence Variant 1 (NM_005228.4, CDS: from 258 to 3890)

```
   1 gtccgggcag ccccccgcgc agcgcggccg cagcagcctc cgcccccgc acggtgtgag
  61 cgcccgacgc ggccgaggcg gccggagtcc cgagctagcc ccggcggccg ccgccgccca
 121 gaccggacga caggccacct cgtcggcgtc cgcccagctc cccgcctcgc cgccaacgcc
 181 acaaccaccg cgcacgcc cctgactccg tccagtattg atcgggagag ccggagcgag
 241 ctcttcgggg agcagcgatg cgaccctccg ggacggccgg gcagcgctc ctggcgctgc
 301 tggctgcgct ctgcccggcg agtcgggctc tggaggaaaa gaaagtttgc caaggcacga
 361 gtaacaagct cacgcagttg ggcacttttg aagatcactt tctcagcctc gagaggtagt
 421 tcaataactg tgaggtggtc cttgggaatt tggaaattac ctatgtgcag aggaattatg
 481 atctttcctt cttaaagacc atccaggagg tggctggtta tgtcctcatt gccctcaaca
 541 cagtggagcg aattcctttg gaaaacctgc agatcatcag aggaaatatg tactacgaaa
 601 attcctatgc cttagcagtc ttatctaact atgatgcaaa taaaaccgga ctgaaggagc
 661 tgcccatgag aaatttacag gaaatcctgc atggcgccgt gcggttcagc aacaaccctg
 721 ccctgtgcaa cgtggagagc atccagtggc gggacatagt cagcagtgac tttctcagca
 781 acatgtcgat ggacttccag aaccacctgg gcagctgcca aaagtgtgat ccaagctgtc
 841 ccaatgggag ctgtgggggt caggagagg gaactgtgac gaaatctcct gtgcccagca
 901 gtgctccggg cgctgccgtg caagtcccc cagtgactgc tgccacaacc
 961 agtgtgctgc aggctgcaca ggccccgggg agagcgactg ccccgtctgc cgcaaattcc
1021 gagacgaagc cacgtgcaag gacacctgcc cccactcat gctctacaac ccaccacgt
1081 accagatgga tgtgaaccc gagggcaaat acagctttgg tgccacctgc gtgaagaagt
1141 gtccccgtaa ttatgtggtg acagatcacg gctcgtgcgt ccgagcctgt ggggccgaca
1201 gctatgagat ggaggaagac ggcgtccgca agtgtaagaa gtgcgaaggg ccttgccgca
1261 aagtgtgtaa cggaataggt attggcgaat ttaaagactc actctccata aatgctacga
1321 atattaaaca cttcaaaaac tgcacctcca tcagtggcga tctccacatc ctgccggtgg
1381 catttagggg tgactccttc acacatactc ctcctctgga tccacaggaa ctggatattc
```

TABLE 1-continued

```
1441 tgaaaaccgt aaaggaaatc acagggtttt tgctgattca ggcttggcct gaaaacagga
1501 cggacctcca tgcctttgag aacctagaaa tcatacgcgg caggaccaag caacatggtc
1561 agttttctct tgcagtcgtc agcctgaaca taacatcctt gggattacgc tccctcaagg
1621 agataagtga tggagatgtg acaatttcag gaaacaaaaa tttgtgctat gcaaatacaa
1681 taaactggaa aaaactgttt gggacctccg gtcagaaaac caaaattata agcaacagag
1741 gtgaaaacag ctgcaaggcc acaggccagg tctgccatgc cttgtgctcc cccgagggct
1801 gctggggccc ggagcccagg gactgcgtct cttgccgaa tgtcagccga ggcagggaat
1861 gcgtggacaa gtgcaacctt ctggagggtg agccaaggga gtttgtggag aactctgagt
1921 gcatacagtg ccacccagag tgcctgcctc aggccatgaa catcacctgc acaggacggg
1981 gaccagacaa ctgtatccag tgtgcccact acattgacgg cccccactgc gtcaagacct
2041 gcccggcagg agtcatggga gaaaacaaca ccctggtctg gaagtacgca gacgccggcc
2101 atgtgtgcca cctgtgccca ccaaactgca cctacggatg cactgggcca ggtcttgaag
2161 gctgtccaac gaatgggcct aagatcccgt ccatcgccac tgggatggtg ggggccctcc
2221 tcttgctgct ggtggtggcc ctggggatcg gcctcttcat gcgaaggcgc cacatcgttc
2281 ggaagcgcac gctgcggagg ctgctgcagg agagggagct tgtggagcct cttacaccca
2341 gtggagaagc tcccaaccaa gctctcttga ggatcttgaa ggaaactgaa ttcaaaaaga
2401 tcaaagtgct gggctccggt gcgttcggca cggtgtataa gggactctgg atcccagaag
2461 gtgagaaagt taaaattccc gtcgctatca aggaattaag agaagcaaca tctccgaaag
2521 ccaacaagga aatcctcgat gaagcctacg tgatggccag cgtggacaac cccacgtgt
2581 gccgcctgct gggcatctgc ctcacctcca ccgtgcagct catcacgcag ctcatgccct
2641 tcggctgcct cctggactat gtccgggaac acaaagacaa tattggctcc cagtacctgc
2701 tcaactggtg tgtgcagatc gcaaagggca tgaactactt ggaggaccgt cgcttggtgc
2761 accgcgacct ggcagccagg aacgtactgg tgaaaacacc gcagcatgtc aagatcacag
2821 attttgggct ggccaaactg ctgggtgcgg aagagaaaga ataccatgca gaaggaggca
2881 aagtgcctat caagtggatg gcattggaat caattttaca cagaatctat acccaccaga
2941 gtgatgtctg gagctacggg gtgactgttt gggagttgat gaccttgga tccaagccat
3001 atgacggaat ccctgccagc gagatctcct ccatcctgga gaaggagaa cgcctccctc
3061 agccacccat atgtaccatc gatgtctaca tgatcatggt caagtgctgg atgatagacg
3121 cagatagtcg cccaaagttc cgtgagttga tcatcgaatt ctccaaaatg gcccgagacc
3181 cccagcgcta ccttgtcatt caggggatg aaagaatgca tttgccaagt cctacagact
3241 ccaacttcta ccgtgccctg atggatgaag aagacatgga cgacgtggtg gatgccgacg
3301 agtacctcat cccacagcag ggcttcttca gcagcccctc cacgtcacgg actcccctcc
3361 tgagctctct gagtgcaacc agcaacaatt ccaccgtggc ttgcattgat agaaatgggc
3421 tgcaaagctg tcccatcaag gaagacagct tcctgcagcg atacagctca gaccccacag
3481 gcgccttgac tgaggacagc atagacgaca ccttcctccc agtgcctgaa tacataaacc
3541 agtccgttcc caaaaggccc gctggctctg tgcagaatcc tgtctatcac aatcagcctc
3601 tgaaccccgc gcccagcaga gacccacact accaggaccc cacagcact gcagtgggca
3661 accccgagta tctcaacact gtccagccca cctgtgtcaa cagcacattc gacagccctg
3721 cccactgggc ccagaaaggc agccaccaaa ttagcctgga caaccctgac taccagcagg
3781 acttctttcc caaggaagcc aagccaaatg gcatcttaa gggctccaca gctgaaaatg
3841 cagaatacct aagggtcgcg ccacaaagca gtgaatttat tggagcatga ccacggagga
3901 tagtatgagc cctaaaaatc cagactcttt cgatacccag gaccaagcca cagcaggtcc
3961 tccatcccaa cagccatgcc cgcattagct cttagaccca cagactggtt ttgcaacgct
4021 tacaccgact agccaggaag tacttccacc tcgggcacat ttttgggaagt tgcattcctt
4081 tgtcttcaaa ctgtgaagca tttacagaaa cgcatccagc aagaatattg tccctttgag
4141 cagaaattta tctttcaaag aggtatattt gaaaaaaaaa aaagtatat gtgaggattt
4201 ttattgattg gggatcttgg agtttttcat tgtcgctatt gattttact tcaatgggct
4261 cttccaacaa ggaagaagct tgctggtagc acttgctacc ctgagttcat ccaggcccaa
4321 ctgtgagcaa ggagcacaag ccacaagtct tccagaggac gcttgattcc agtggttctg
4381 cttcaaggct tccactgcaa aacactaaag atccaagaag gccttcatgg ccccagcagg
4441 ccggatcggt actgtatcaa gtcatggcag gtacagtagg ataagccact ctgtcccttc
4501 ctgggcaaag aagaaacgga ggggatggaa ttcttccta gacttacttt tgtaaaaatg
4561 tccccacggt acttactccc cactgatgga ccagtggctt ccagtcatga gcgttagact
4621 gacttgtttg tcttccattc cattgttttg aaactcagta tgctgccct gtcttgctgt
4681 catgaaatca gcaagagagg atgacacatc aaataataac tcggattcca gcccacattg
4741 gattcatcag catttggacc aatagcccac agctgagaat gtggaatacc taaggatagc
4801 accgcttttg ttctcgcaaa aacgtatctc ctaatttgag gcccagatga aatgcatcag
4861 gtcctttggg gcatagatca gaagactaca aaaatgaagc tgctctgaaa tctccttag
4921 ccatcaccc aacccccaa aattagtttg tctcttt ggaagatagt tttctccttt
4981 tacttcactt caaaagcttt ttactcaaag agtatatgtt ccctccaggt cagctgccc
5041 caaaccccct ccttacgctt tgtcacacaa aaagtgtctc tgccttgagt catctattca
5101 agcacttaca gctctggcca caacagggca ttttacaggt gcgaatgaca gtagcattat
5161 gagtagtgtg gaattcaggt agtaaatatg aaactagggt ttgaaattga taatgctttc
5221 acaacatttg cagatgtttt agaaggaaaa aagttccttc ctaaaataat ttctctacaa
5281 ttggaagatt ggaagattca gctagttagg agcccacctt ttttcctaat ctgtgtgtgc
5341 cctgtaacct gactggttaa cagcagtcct ttgtaaacag tgttttaaac tctcctagtc
5401 aatatccacc ccatccaatt tatcaaggaa gaaatgtctg agaaaatatt ttcagcctac
5461 agttatgttc agtcacacac acatacaaaa tgttccttt gcttttaaag taattttga
5521 ctcccagatc agtcagagcc cctacagcat tgttaagaaa gtatttgatt tttgtctcaa
5581 tgaaaataaa actatattca tttccactct attatgctct caaatacccc taagcatcta
5641 tactagcctg gtatgggtat gaaagataca aagtaaaata aaacatagtc cctgattcta
5701 agaaattcac aatttagcaa aggaaatgga ctcatgatg ctaaccttaa aacaacgtga
5761 caaatgccag acaggaccca tcagccaggc actgtgagag cacagagcag ggaggttggg
5821 tcctgcctga ggagacctgg aagggaggcc tcacaggagg atgaccaggt ctcagtcagc
5881 ggggaggtgg aaagtgcagg tgcatcaggg gcaccctgac cgaggaaaca gctgccagag
5941 gcctccactg ctaaagtcca cataaggctg aggtcagtca ccctaaacaa cctgctccct
6001 ctaagccagg ggatgagctt ggagcatccc acaagttccc taaagttgc agccccagg
6061 gggattttga gctatcatct ctgcacatgc ttagtgagaa gactacacaa catttctaag
6121 aatctgagat tttatattgt cagttaacca ctttcattat tcattcacct caggacatgc
6181 agaaatattt cagtcagaac tgggaaacag aaggacctac attctgctgt cacttatgtg
```

TABLE 1-continued

```
6241 tcaagaagca gatgatcgat gaggcaggtc agttgtaagt gagtcacatt gtagcattaa
6301 attctagtat ttttgtagtt tgaaacagta acttaataaa agagcaaaag ctaaaaaaaa
6361 aaaaaaaaa
```

SEQ ID NO: 92 Human EGFR Amino Acid Sequence Isoform A (NP_005219.2)
```
   1 mrpsgtagaa llallaalcp asraleekkv cqgtsnkltq lgtfedhfls lqrmfnncev
  61 vlgnleityv qrnydlsflk tiqevagyvl ialntverip lenlqiirgn myyensyala
 121 vlsnydankt glkelpmrnl qeilhgavrf snnpalcnve siqwrdivss dflsnmsmdf
 181 qnhlgscqkc dpscpngscw gageencqkl tkiicaqqcs grcrgkspsd cchnqcaagc
 241 tgpresdclv crkfrdeatc kdtcpplmly npttyqmdvn pegkysfgat cvkkcprnyv
 301 vtdhgscvra cgadsyemee dgvrkckkce gpcrkvcngi gigefkdsls inatnikhfk
 361 nctsisgdlh ilpvafrgds fthtppldpq eldilktvke itgflliqaw penrtdlhaf
 421 enleiirgrt kqhgqfslav vslnitslgl rslkeisdgd viisgnknlc yantinwkkl
 481 fgtsgqktki isnrgensck atgqvchalc spegcwgpep rdcvscrnvs rgrecvdkcn
 541 llegeprefv enseciqchp eclpqamnit ctgrgpdnci qcahyidgph cvktcpagvm
 601 genntlvwky adaghvchlc hpnctygctg pglegcptng pkipsiatgm vgalllllvv
 661 algiglfmrr rhivrkrtlr rllqerelve pltpsgeapn qallrilket efkkikvlgs
 721 gafgtvykgl wipegekvki pvaikelrea tspkankeil deayvmasvd nphvcrllgi
 781 cltsrvqlit qlmpfgclld yvrehkdnig sqyllnwcvq iakgmnyled rrlvhrdlaa
 841 rnvlvktpqh vkitdfglak llgaeekeyh aeggkvpikw malesilhri ythqsdvwsy
 901 gvtvwelmtf gskpydgipa seissilekg erlpqppict idvymimvkc wmidadsrpk
 961 freliiefsk mardpqrylv iqgdermhlp sptdsnfyra lmdeedmddv vdadeylipq
1021 qgffsspsts rtpllsslsa tsnnstvaci drnglqscpi kedsflqrys sdptgalted
1081 sidddtflpvp eyinqsvpkr pagsvqnpvy hnqplnpaps rdphyqdphs tavgnpeyln
1141 tvqptcvnst fdspahwaqk gshqisldnp dyqqdffpke akpngifkgs taenaeylrv
1201 apqssefiga
```

SEQ ID NO 93 Human HGFR CPNA Sequence Variant 2 (NM_201282.1, CDS:
from 247 to 2133)
```
   1 ccccggcgca gcgcggccgc agcagcctcc gcccccgca cggtgtgagc gcccgacgcg
  61 gccgaggcgg ccggagtccc gagctagccc cggcggccgc cgccgcccag accggacgac
 121 aggccacctc gtcggcgtcc gcccgagtcc ccgcctcgcc gccaacgcca caaccaccgc
 181 gcacggcccc ctgactccgt ccagtattga tcgggagagc cggagcgagc tcttcgggga
 241 gcagcgatgc gaccctccgg gacggccggg gcagcgctcc tggcgctgct ggctgcgctc
 301 tgcccggcga gtcgggctct ggaggaaaag aaagtttgcc aaggcacgaa taacaagctc
 361 acgcagttgg gcacttttga agatcatttt ctcagcctcc agaggatgtt caataactgt
 421 gaggtggtcc ttgggaattt ggaaattacc tatgtgcaga ggaattatga tctttccttc
 481 ttaaagacca tccaggaggt ggctggttat gtcctcattg ccctcaacac agtggagcga
 541 attcctttgg aaaacctgca gatcatcaga ggaaatatgt actacgaaaa ttcctatgcc
 601 ttagcagtct tatctaacta tgatgcaaat aaaaccggac tgaaggagct gcccatgaga
 661 aatttacagg aaatcctgca tggcgccgtg cggttcagca caaccctgc cctgtgcaac
 721 gtggagagca tccagtggcg ggacatagtc agcagtgact ttctcagcaa catgtcgatg
 781 gacttccaga accacctggg cagctgccaa aagtgtgatc caagctgtcc caatgggagc
 841 tgctggggtg caggagagga gaactgccag aaactgacca aaatcatctg tgcccagcag
 901 tgctccgggc gctgccgtgg caagtccccc agtgactgct gccacaacca gtgtgctgca
 961 ggctgcacag gccccccgga gagcgactgc ctggtctgcc gcaaattccg agacgaagcc
1021 acgtgcaagg acacctgccc cccactcatg ctctacaacc ccaccacgta ccagatggat
1081 gtgaacccgg agggcaaata cagctttggt gccacctgcg tgaagaagtg ccccgtaat
1141 tatgtggtga cagatcacgc ctcgtgcgtc cgagcctgtg ggccgacag ctatgagatg
1201 gaggaagacg gcgtccgcaa gtgtaagaag tgcgaaggc cttgccgcaa agtgtgtaac
1261 ggaataggta ttggtgaatt taaagactca ctctccaataa atgctacgaa tattaaacac
1321 ttcaaaaact gcacctccat cagtggcgat ctccacatcc tgccggtggc atttaggggt
1381 gactcctttca cacatactcc tcctctggat ccacaggaac tggatattct gaaaaccgta
1441 aaggaaatca cagggttttt gctgattcag gcttggcctg aaaacaggac ggactccat
1501 gcctttgaga acctagaaat catacgcggc aggaccaagc aacatggtca gttttctctt
1561 gcagtcgtca gcctgaacat aacatccttg ggattacgct ccctcaagga gataagtgat
1621 ggagatgtga aatttcagg aaacaaaaat ttgtgctatg caaatacaat aaactggaaa
1681 aaactgtttg gacctccgg tcagaaaacc aaaattataa gcaacagagg tgaaaacagc
1741 tgcaaggcca caggccaggt ctgccatgcc ttggtctccc ccgaggctg ctgggccg
1801 gagcccaggg actgcgtctc ttgccggaat gtcagccgag cagggaatg cgtggacaag
1861 tgcaaccttc tggagggtga gccaagggag tttgtggaga ctctgagtg catacagtgc
1921 cacccagagt gcctgcctca ggcatgaac atcacctgca caggacgggg accagacaac
1981 tgtatccagt gtccccacta cattgacggc ccccactgcg tcaagacctg ccgggcagga
2041 gtcatgggag aaaacaacac cctggtctgg aagtacgcag acgccggcca tgtgtgccac
2101 ctgtgccatc caaactgcac ctacgggtcc taataaatct tcactgtctg actttagtct
2161 cccactaaaa ctgcatttcc tttctacaat ttcaatttct ccctttgcct caaataaagt
2221 cctgacacta ttcatttga
```

SEQ ID NO: 94 Human EGFR Amino Acid Sequence Isoform B (NP_958439.1)
```
   1 mrpsgtagaa llallaalcp asraleekkv cqgtsnkltq lgtfedhfls lqrmfnncev
  61 vlgnleityv qrnydlsflk tiqevagyvl ialntverip lenlqiirgn myyensyala
 121 vlsnydankt glkelpmrnl qeilhgavrf snnpalcnve siqwrdivss dflsnmsmdf
 181 qnhlgscqkc dpscpngscw gageencqkl tkiicaqqcs grcrgkspsd cchnqcaagc
 241 tgpresdclv crkfrdeatc kdtcpplmly npttyqmdvn pegkysfgat cvkkcprnyv
 301 vtdhgscvra cgadsyemee dgvrkckkce gpcrkvcngi gigefkdsls inatnikhfk
 361 nctsisgdlh ilpvafrgds fthtppldpq eldilktvke itgflliqaw penrtdlhaf
 421 enleiirgrt kqhgqfslav vslnitslgl rslkeisdgd viisgnknlc yantinwkkl
 481 fgtsgqktki isnrgensck atgqvchalc spegcwgpep rdcvscrnvs rgrecvdkcn
 541 llegeprefv enseciqchp eclpqamnit ctgrgpdnci qcahyidgph cvktcpagvm
 601 genntlvwky adaghvchlc hpnctygs
```

TABLE 1-continued

SEQ ID NO: 95 Human EGFR cDNA Sequence Variant 3 (NM_201283.1, CDS: from 247 to 1464)

```
   1 ccccggcgca gcgcggccgc agcagcctcc gccccccgca cggtgtgagc gcccgacgcg
  61 gccgaggcgg ccggagtccc gagctagccc cggcggccgc cgccgcccag accggacgac
 121 aggccacctc gtcggcgtcc gcccgagtcc ccgcctcgcc gccaacgcca caaccaccgc
 181 gcacggcccc ctgactccgt ccagtattga tcgggagagc cggagcgagc tcttcgggga
 241 gcagcgatgc gaccctccgg gacggccggg gcagcgctcc tggcgctgct ggctgcgctc
 301 tgcccggcga gtcgggctct ggaggaaaag aaagtttgcc aaggcacgag taacaagctc
 361 acgcagttgg gcacttttga agatcatttt ctcagcctcc agaggatgtt caataactgt
 421 gaggtggtcc ttgggaattt ggaaattacc tatgtgcaga ggaattatga tcttttccttc
 481 ttaaagacca tccaggaggt ggctggttat gtcctcattg ccctcaacac agtggagcga
 541 attcctttgg aaaacctgca gatcatcaga ggaaatatgt actacgaaaa ttcctatgcc
 601 ttagcagtct tatctaacta tgatgcaaat aaaaccggac tgaaggagct gcccatgaga
 661 aatttacagg aaatcctgca tggcgccgtg cggttcagca acaaccctgc cctgtgcaac
 721 gtggagagca tccagtggcg ggacatagtc agcagtgact ttctcagcaa catgtcgatg
 781 gacttccaga accacctggg cagctgccaa aagtgtgatc caagctgtcc caatgggagc
 841 tgctgggggtg caggagagga gaactgccag aaactgacca aaatcatctg tgcccagcag
 901 tgctccgggc gctgccgtgg caagtccccc agtgactgct gccacaacca gtgtgctgca
 961 ggctgcacag gcccccggga gagcgactgc ctggtctgcc gcaaattccg agacgaagcc
1021 acgtgcaagg acacctgccc cccactcatg ctctacaacc ccaccacgta ccagatggat
1081 gtgaaccccg agggcaaata cagctttggt gccacctgcg tgaagaagtg tccccgtaat
1141 tatgtggtga cagatcacgc ctcgtgcgtc cgagcctgtg gggccgacag ctatgagatg
1201 gaggaagacg gcgtccgcaa gtgtaagaag tgcgaagggc cttgccgcaa agtgtgtaac
1261 ggaataggta ttggtgaatt taaagactca ctctccataa atgctacgaa tattaaacac
1321 ttcaaaaact gcacctccat cagtggcgat cccacatcc tgccggtggc atttaggggt
1381 gactccttca cacatactcc tcctctggat ccacaggaac tggatattct gaaaaccgta
1441 aaggaaatca caggttttgag ctgaattatc acatgaatat aaatgggaaa tcagtgtttt
1501 agagagagaa cttttcgaca tatttcctgt tcccttggaa taaaaacatt tcttctgaaa
1561 ttttaccgtt aaaaaaaaaa aaaaaaaaa aaaaa
```

SEQ ID NO: 96 Human EGFR Amino Acid Sequence Isoform C (NP_958440.1)

```
   1 mrpsgtagaa llallaalcp asraleekkv cqgtsnkltq lgtfedhfls lqrmfnncev
  61 vlgnleityv qrnydlsflk tiqevagyvl ialntverip lenlqiirgn myyensyala
 121 vlsnydankt glkelpmrnl qeilhgavrf snnpalcnve siqwrdivss dflsnmsmdf
 181 qnhlgscqkc dpscpngscw gageencqkl tkiicaqqcs grcrgksped cchnqcaagc
 241 tgpresdclv crkfrdeatc kdtcpplmly npttyqmdvn pegkysfgat cvkkcprnyv
 301 vtdhgscvra cgadsyemee dgvrkckkce gpcrkvcngi gigefkdsls inatnikhfk
 361 nctsisgdlh ilpvafrgds fthtppldpq eldilktvke itgls
```

SEQ ID NP: 97 Human EGFR cDNA Sequence Variant 4 (NM_201284.1, CDS: from 247 to 2364)

```
   1 ccccggcgca gcgcggccgc agcagcctcc gccccccgca cggtgtgagc gcccgacgcg
  61 gccgaggcgg ccggagtccc gagctagccc cggcggccgc cgccgcccag accggacgac
 121 aggccacctc gtcggcgtcc gcccgagtcc ccgcctcgcc gccaacgcca caaccaccgc
 181 gcacggcccc ctgactccgt ccagtattga tcgggagagc cggagcgagc tcttcgggga
 241 gcagcgatgc gaccctccgg gacggccggg gcagcgctcc tggcgctgct ggctgcgctc
 301 tgcccggcga gtcgggctct ggaggaaaag aaagtttgcc aaggcacgag taacaagctc
 361 acgcagttgg gcacttttga agatcatttt ctcagcctcc agaggatgtt caataactgt
 421 gaggtggtcc ttgggaattt ggaaattacc tatgtgcaga ggaattatga tcttttccttc
 481 ttaaagacca tccaggaggt ggctggttat gtcctcattg ccctcaacac agtggagcga
 541 attcctttgg aaaacctgca gatcatcaga ggaaatatgt actacgaaaa ttcctatgcc
 601 ttagcagtct tatctaacta tgatgcaaat aaaaccggac tgaaggagct gcccatgaga
 661 aatttacagg aaatcctgca tggcgccgtg cggttcagca acaaccctgc cctgtgcaac
 721 gtggagagca tccagtggcg ggacatagtc agcagtgact ttctcagcaa catgtcgatg
 781 gacttccaga accacctggg cagctgccaa aagtgtgatc caagctgtcc caatgggagc
 841 tgctgggggtg caggagagga gaactgccag aaactgacca aaatcatctg tgcccagcag
 901 tgctccgggc gctgccgtgg caagtccccc agtgactgct gccacaacca gtgtgctgca
 961 ggctgcacag gcccccggga gagcgactgc ctggtctgcc gcaaattccg agacgaagcc
1021 acgtgcaagg acacctgccc cccactcatg ctctacaacc ccaccacgta ccagatggat
1081 gtgaaccccg agggcaaata cagctttggt gccacctgcg tgaagaagtg tccccgtaat
1141 tatgtggtga cagatcacgc ctcgtgcgtc cgagcctgtg gggccgacag ctatgagacg
1201 gaggaagacg gcgtccgcaa gtgtaagaag tgcgaagggc cttgccgcaa agtgtgtaac
1261 ggaataggta ttggtgaatt taaagactca ctctccaaa atgctacgaa tattaaacac
1321 ttcaaaaact gcacctccat cagtggcgat cccacatcc tgccggtggc atttaggggt
1381 gactccttca cacatactcc tcctctggat ccacaggaac tggatattct gaaaaccgta
1441 aaggaaatca caggttttt gctgattcag gcttggcctg aaaacaggac ggacctccat
1501 gcctttgaga acctagaaat catacgcggc aggaccaagc aacatggtca gttttctctt
1561 gcagtcgtca gcctgaacat aacatccttg ggattacgct ccctcaagga gataagtgat
1621 ggagatgtga aatttcagg aaacaaaaat ttgtgctatg caaacacaat aaactggaaa
1681 aaactgtttg ggacctccgg tcagaaaacc aaaattataa gcaacagagg tgaaaacagc
1741 tgcaaggcca caggccaggt ctgccatgcc ttgtgctccc ccgagggctg ctggggcccg
1801 gagcccaggg actgcgtctc ttgccggaat gtcagccgag gcagggaatg cgtggacaag
1861 tgcaaccttc tggagggtga gccaagggag tttgtggaga ctctgagtg catacagtgc
1921 cacccagagt gcctgcctca ggccatgaac atcacctgca cggcagggg accagacaac
1981 tgtatccagt gtgcccacta cattgacggc ccccactgcg tcaagacctg cccggcagga
2041 gtcatgggag aaaacaacac cctggtctgg aagtacgcag acgccggcca tgtgtgccac
2101 ctgtgccatc caaactgcac ctacgggcca ggaaatgaga gtctcaaagc catgttattc
2161 tgcctttta aactatcatc ctgtaatcaa agtaatgatg gcagcgtgtc ccaccagagc
2221 gggagcccag ctgctcagga gtcatgctta ggatggatcc cttctcttct gccgtcagag
```

TABLE 1-continued

```
2281 tttcagctgg gttggggtgg atgcagccac ctccatgcct ggccttctgc atctgtgatc
2341 atcacggcct cctcctgcca ctgagcctca tgccttcacg tgtctgttcc cccgctttt
2401 cctttctgcc acccctgcac gtgggccgcc aggttccaa gagtatccta cccatttcct
2461 tccttccact ccctttgcca gtgcctctca ccccaactag tagctaacca tcaccccag
2521 gactgacctc ttcctcctcg ctgccagatg attgttcaaa gcacagaatt tgtcagaaac
2581 ctgcagggac tccatgctgc cagccttctc cgtaattagc atggccccag tccatgcttc
2641 tagccttggt tccttctgcc cctctgtttg aaattctaga gccagctgtg ggacaattat
2701 ctgtgtcaaa agccagatgt gaaaacatct caataacaaa ctggctgctt tgttcaatgc
2761 tagaacaacg cctgtcacag agtagaaact caaaatatt tgctgagtga atgaacaaat
2821 gaataaatgc ataataaata attaaccacc aatccaacat ccaga
```

SEQ ID NO: 98 Human EGFR Amino Acid Sequence Isoform D (NP_95844.1)

```
  1 mrpsgtagaa llallaalcp asraleekkv cqgtsnkltq lgtfedhfls lqrmfnncev
 61 vlgnleityv qrnydlsflk tiqevagyvl ialntverip lenlqiirgn myyensyala
121 vlsnydankt glkelpmrnl qeilhgavrf snnpalcnve siqwrdivss dflsnmsmdf
181 qnhlgscqkc dpscpngscw gageencqkl tkiicaqqcs grcrgkspsd cchnqcaagc
241 tgpresdclv crkfrdeatc kdtcpplmly npttyqmdvn pegkystgat cvkkcprnyv
301 vtdhgscvra cgadsyemee dgvrkckkce gpcrkvcngi gigefkdsls inatnikhfk
361 nctsisgdlh ilpvafrgds fthtppldpq eldilktvke itgflliqaw penrtdlhaf
421 enleiirgrt kqhgqfslav vslnitslgl rslkeisdgd viisgnknlc yantinwkkl
481 fgtsgqktki isnrgensck atgqvchalc spegcwgpep rdcvscrnvs rgrecvdkcn
541 llegeprefv enseciqchp eclpqamnit ctgrgpdnci qcahyidgph cvktcpagvm
601 genntlvwky adaghvchlc hpnctygpgn eslkamlfcl fklsscnqsn dgsvshqsgs
661 paaqesclgw ipsllpsefq lgwggcshlh awpsasvilt assch
```

SEQ ID NO: 99 Human EGFR cDNA Sequence Variant 5 (NM_001346897.1, CDS: from 258 to 3533)

```
   1 gtccgggcag ccccccggcgc agcgcggccg cagcagcctc cgcccccgc acggtgtgag
  61 cgcccgacgc ggccgaggcg gccggagtcc cgagctagcc cggcggccg ccgccgccca
 121 gaccggacga caggccacct cgtcggcgtc cgcccgagtc cccgcctcgc cgccaacgcc
 181 acaaccaccg cgcacggccc cctgactccg tccagtattg atcgggagag ccggagcgag
 241 ctcttcgggg agcagcgatg cgaccctccg gacggccgg ggcagcgctc ctggcgctgc
 301 tggctgcgct ctgcccggcg agtcgggctc tggaggaaaa gaaagtttgc caaggcacga
 361 gtaacaagct cacgcagttg ggcactttg aagatcctt tctcagcctc cagaggatgt
 421 tcaataactg tgaggtggtc cttgggaatt tggaaattac ctatgtgcag aggaattatg
 481 atctttcctt cttaaagacc atccaggagg tggctggtta tgtcctcatt gccctcaaca
 541 cagtggagcg aattcctttg gaaaacctgc agatcatcag aggaaatatg tactacgaaa
 601 attcctatgc cttagcagtc ttatctaact atgatgcaaa taaaaccgga ctgaaggagc
 661 tgcccatgag aaatttacag ggccaaaagt gtgatccaag ctgtcccaat gggagctgct
 721 ggggtgcagg agaggagaac tgcagaaac tgaccaaaat catctgtgcc cagcagtgct
 781 ccgggcgctg ccgtggcaag tccccagtg actgctgcca caaccagtgt gctgcaggct
 841 gcacaggccc ccgggagagc gactgcctgg tctgccgcaa attccgagac gaagccaagt
 901 gcaaggacac ctgccccca ctcatgctct acaacccac cacgtaccag atggatgtga
 961 accccgaggg caaatacagc tttggtgcca cctgcgtgaa gaagtgtccc cgtaattatg
1021 tggtgacaga tcacggctcg tgcgtccgag cctgtggggc cgacagctat gagatggagg
1081 aagacggcgt ccgcaagtgt aagaagtgcg aagggcctgc ccgcaaagtg tgtaacggaa
1141 taggtattgg tgaatttaaa gactcactct ccataaatgc tacgaatatt aaacacttca
1201 aaaactgcac ctccatcagt ggcgatctcc acatcctgcc ggtggcattt aggggtgact
1261 ccttcacaca tactcctcct ctggatccac aggaactgga tattctgaaa accgtaaagg
1321 aaatcacagg gtttttgctg attcaggctt ggcctgaaga caggacgac ctccatgcct
1381 ttgagaacct agaaatcata cgcggcagga ccaagcaaca tggtcagttt tctccttgcag
1441 tcgtcagcct gaacataaca tccttgggat tacgctcccc caaggagata agtgatggag
1501 atgtgataat tcaggaaac aaaaatttgt gctatgcaaa tacaataaac tggaaaaaac
1561 tgtttgggac ctccggtcag aaaaccaaaa ttataagcaa cagaggtgaa aacagctgca
1621 aggccacagg ccaggtctgc catgccttgt gctcccccga gggctgctgg gccccggagc
1681 ccagggactg cgtctcttgc cggaatgtca gccgaggcag ggaatgcgtg gacaagtgca
1741 accttctgga gggtgagcca agggagtttg tggagaactc tgagtgcata cagtgccacc
1801 cagagtgcct gcctcaggcc atgaacatca cctgcacagg acggggacca gacaactgta
1861 tccagtgtgc ccactacatt gacggcccc actgcgtcaa gacctgcccg gcaggagtca
1921 tgggagaaaa caacaccctg gtctgaagt acgcagacgc cggccatgtg tgccacctgt
1981 gccatccaaa ctgcacctac ggatgcactg gccaggtct tgaaggctgt ccaacgaatg
2041 ggcctaagat cccgtccatc gccactggga tggtggggc cctcctcttg ctgctggtgg
2101 tggccctggg gatcggcctc ttcatgcgaa ggcgccacat cgttcggaag cgcacgctgc
2161 ggaggctgct gcaggagagg gagcttgtgg agcctcttac acccagtgga gaagctccca
2221 accaagctct cttgaggatc ttgaaggaaa ctgaattcaa aaagatcaaa gtgctgggct
2281 ccggtgcgtt cggcacggta tataagggac tctggatccc agaaggtgag aaagttaaaa
2341 ttccccgtcgc tatcaaggaa ttaagagaag caacatctcc gaaagccaac aaggaaatcc
2401 tcgatgaagc ctacgtgatg gccagcgtgg acaaccccca cgtgtgccgc ctgctgggca
2461 tctgcctcac ctccaccgtg cagctcatca gcagctcat gccttcggc tgcctcctgg
2521 actatgtccg ggaacacaaa gacaatattg ctcccagta cctgctcaac tggtgtgtgc
2581 agatcgcaaa gggcatgaac tacttggagg accgtcgctt ggtgcaccgc gaccttgcag
2641 ccaggaacgt actggtgaaa acaccgcagc atgtcaagat cacagatttt gggctggcca
2701 aactgctggg tgcggaaagag aaagaatacc atgcagaagg aggcaaagtg cctatcaagt
2761 ggatggcatt ggaatcaatt ttacacagaa tctataccca ccagagtgat gtctggagct
2821 acggggtgac tgtttgggag ttggtgacct ttggatccaa gccatatgac ggaatccctg
2881 ccagcgagat ctcctccatc ctggagaaag gagaacgcct ccctcagcca cccatatgta
2941 ccatcgatgt ctacatgatc atggtcaagt gctggatgat agacgcagat agtgcccaa
3001 agttccgtga gttgatcatc gaattctcca aaatggcccg agaccccag cgctaccttg
3061 tcattcaggg ggatgaaaga atgcatttgc caagtcctac agactccaac ttctaccgtg
3121 ccctgatgga tgaagaagac atggacgacg tggtggatgc cgacgagtac ctcatcccac
```

TABLE 1-continued

```
3181 agcagggctt cttcagcagc ccctccacgt cacggactcc cctcctgagc tctctgagtg
3241 caaccagcaa caattccacc gtggcttgca ttatagaaa tgggctgcaa agctgtccca
3301 tcaaggaaga cagcttcttg cagcgataca gctcagaccc acaggcgcc ttgactgagg
3361 acagcataga cgacaccttc ctcccagtgc ctggtgagtg gcttgtctgg aaacagtcct
3421 gctcctcaac ctcctcgacc cactcagcag cagccagtct ccagtgtcca agccaggtgc
3481 tccctccagc atctccagag ggggaaacag tggcagattt gcagacacag tgaagggcgt
3541 aaggagcaga taaacacatg accgagcctg cacaagctct tgttgtgtc tggttgtttg
3601 ctgtacctct gttgtaagaa tgaatctgca aaatttctag cttatgaagc aaatcacgga
3661 catacacatc tgtgtgtgtg agtgttcatg atgtgtgtac atctgtgtat gtgtgtgtgt
3721 gtatgtgtgt gtttgtgaca gatttgatcc ctgttctctc tgctggctct atcttgacct
3781 gtgaaacgta tatttaacta attaaatatt agttaatatt aataaatttt aagctttatc
3841 cagaaaaaaa aaaaaaaaa
```

SEQ ID NO: 100 Human EGFR Amino Acid Sequence Isoform E (NP_001333826.1)
```
   1 mrpsgtagaa llallaalcp asraleekkv cqgtsnkltq lgtfedhfls lqrmfnncev
  61 vlgnleityv qrnydlsflk tiqevagyvl ialntverip lenlqiirgn myyensyala
 121 vlsnydankt glkelpmrnl qgqkcdpscp ngscwgagee ncqkltkiic aqqcsgrcrg
 181 kspsdcchnq caagctgpre sdclvcrkfr deatckdccp plmlynptty qmdvnpegky
 241 sfgatcvkkc prnyvvtdhg scvracgads yemeedgvrk ckkcegpcrk vcngigigef
 301 kdslsinatn ikhfknctsi sgdlhilpva frgdsfthtp pldpqeldil ktvkeitgfl
 361 liqawpenrt dlhafenlei irgrtkqhgq fslavvslni tslglrslke isdgdviisg
 421 nknlcyanti nwkklfgtsg qktkiisnrg ensckatgqv chalcspegc wgeprdcvs
 481 crnvsrgrec vdkcnllege prefvensec iqchpeclpq amnitctgrg pdnciqcahy
 541 idgphcvktc pagvmgennt lvwkyadagh vchlchpnct ygctgpgleg cptngpkips
 601 iatgmvgall lllvvalgig lfmrrrhivr krtlrrllqe relvepltps geapnqallr
 661 ilketefkki kvlgsgafgt vykglwipeg ekvkipvaik elreatspka nkeildeayv
 721 masvdnphvc rllgicltst vqlitqlmpf gclldyvreh kdnigsqyll nwcvqiakgm
 781 nyledrrlvh rdlaarnvlv ktpqhvkitd fglakllgae ekeyhaeggk vpikwmales
 841 ilhriythqs dvwsygvtvw elmtfgskpy dgipaseiss ilekgerlpq ppictidvym
 901 imvkcwmida dsrpkfreli iefskmardp qrylviqgde rmhlpsptds nfyralmdee
 961 dmddvvdade ylipqqgffs spstsrtpll sslsatsnns tvacidrngl qscpikedsf
1021 lqryssdptg altedsiddt flpvpgewlv wkqscsstss thsaaaslqc psqvlppasp
1081 egetvadlqt q
```

SEQ ID NO: 101 Human EGFR cDNA Sequence Variant 6 (NM_001346898.1, CDS: from 258 to 3668)
```
   1 gtccgggcag ccccccggcgc agcgcggccg cagcagcctc cgccccccgc acgtgtgag
  61 cgcccgacgc ggccgaggcg gccggagtcc cgagctagcc cggcggccg ccgccgccca
 121 gaccggacga caggccacct cgtcggcgtc cgcccgagtc cccgcctcgc cgccaacgcc
 181 acaaccaccg cgcacggccc cctgactccg tccagtattg atcgggagag ccggagcgag
 241 ctcttcgggg agcagcgatg cgaccctccg gacggccgg ggcagcgctc ctggcgctgc
 301 tggctgcgct ctgcccgccg agtcgggctc tggaggaaaa gaaagttgc caaggcacga
 361 gtaacaagct cacgcagttg ggcacttttg aagatcattt tctcagcctc cagaggatgt
 421 tcaataactg tgaggtggtc cttgggaatt tggaaattac ctatgtgcag aggaattatg
 481 atctttcctt cttaaagacc atccaggagg tggctggtta tgtcctcatt gccctcaaca
 541 cagtggacg aattcctttg gaaaacctgc agatcatcag aggaaatatg tactacgaaa
 601 attcctatgc cttagcagtc ttatctaact atgatgcaaa taaaaccgga ctgaaggagc
 661 tgcccatgag aaatttacag gaaatcctgc atggcgccgt gcggttcagc aacaaccctg
 721 ccctgtgcaa cgtggagagc atccagtggc gggacatagt cagcagtgac ttcctcagca
 781 acatgtcgat ggacttccag aaccacctgg gcagctgcca aaagtgtgat ccaagctgtc
 841 ccaatgggag ctgctgggt gcaggagagg agaactgcca gaaactgacc aaaatcatct
 901 gtgcccagca gtgctccggg cgctgccgtg gcaagtcccc cagtgactgc tgccacaacc
 961 agtgtgctgc aggctgcaca ggcccccggg agagcgactg cctggtctgc cgcaaattcc
1021 gagacgaagc cacgtgcaag gacacctgcc cccactcat gcctacaac ccaccacgt
1081 accagatgga tgtgaacccc gagggcaaat acagctttg tgccacctgc gtgaagaagt
1141 gtccccgtaa ttatgtggtg acagatcacg gctcgtgcgt ccgagcctgt ggggccgaca
1201 gctatgagat ggaggaagac ggcgtccgca agtgtaagaa gtgcgaaggg ccttgccgca
1261 aagtgtgtaa cggaataggt attggtgaat ttaaagactc actctccata aatgctacga
1321 atattaaaca cttcaaaaac tgcacctcca tcagtggcga tctccacatc ctgccggtgg
1381 catttagggg tgactccttc acacatactc ctcctctgga tccacaggaa ctggatattc
1441 tgaaaaccgt aaaggaaatc acagggttt tgctgattca ggcttggcct gaaaacagga
1501 cggacctcca tgcctttgag aacctagaaa tcatacgcgg caggaccaag caacatggtc
1561 agttttctct tgcagtcgtc agcctgaaca taacatcctt ggattactgc tccctcaagg
1621 agataagtga tggagatgtg ataatttcag gaaacaaaaa tttgtgctat gcaaatacaa
1681 taaactggaa aaaactgttt gggaccttccg gtcagaaaac caaaattata agcaacagag
1741 gtgaaaacag ctgcaaggcc acaggccagg tctgccatgc cttgtgctcc cccgagggct
1801 gctgggggcc ggagcccagg gactgcgtct cttgccggaa tgtcagccga ggcagggaat
1861 gcgtggacaa gtgcaacctt ctggaggtg agccaaggga gtttgtggag aactctgagt
1921 gcatacagtg ccacccagag tgcctgcctc aggccatgaa catcacctgc acaggacggg
1981 gaccagacaa ctgtatccag tgtgcccact acattgacgg cccccactgc gtcaagacct
2041 gcccggcagg agtcatggga gaaaacaaca cccggttctg gaagtacgca gacgccgcc
2101 atgtgtgcca cctgtgccat ccaaactgca cctacggatg cactgggcca ggtcttgaag
2161 gctgtccaac gaatgggcct aagatccgt ccatcgccac tgggatggtg gggccctcc
2221 tcttgctgct ggtggtggcc ctgggatcg gcctcttcat gcgaaggcgc cacatcgttc
2281 ggaagcgcac gctgcggagg ctgctgcagg agagggagct tgtggagcct ttacaccca
2341 gtggagaagc tccccaaccaa gctctcttga ggatcttgaa ggaactgaa ttcaaaaaga
2401 tcaaagtgct gggctccggt gcgttcggca cggtgtataa gggactctgg atcccagaag
2461 gtgagaaagt taaaattccc gtcgctatca aggaattaag agaagcaaca tctccgaaag
2521 ccaacaagga aatcctcgat gaagcctacg tgatggccag cgtggacaac cccacgtgt
2581 gccgcctgct gggcatctgc ctcacctcca ccgtgcagct catcacgcag ctcatgccct
```

TABLE 1-continued

```
2641 tcggctgcct cctggactat gtccgggaac acaaagacaa tattggctcc cagtacctgc
2701 tcaactggtg tgtgcagatc gcaaagggca tgaactactt ggaggaccgt cgcttggtgc
2761 accgcgacct ggcagccagg aacgtactgg tgaaaacacc gcagcatgtc aagatcacag
2821 attttgggct ggccaaactg ctgggtgcgg aagagaaaa ataccatgca gaaggaggca
2881 aagtgcctat caagtggatg gcattggaat caattttaca cagaatctat acccaccaga
2941 gtgatgtctg gagctacggg gcgactgttt gggagttgat gacctttgga tccaagccat
3001 atgacggaat ccctgccagc gagatctcct ccatcctgga aaaggagaa cgcctccctc
3061 agccacccat atgtaccatc gatgtctaca tgatcatggt caagtgctgg atgatagacg
3121 cagatagtcg cccaaagttc cgtgagttga tcatcgaatt ctccaaaatg gcccgagacc
3181 cccagcgcta ccttgtcatt caggggggatg aaagaatgca tttgccaagt cctacagact
3241 ccaacttcta ccgtgccctg atggatgaag aagacatgga cgacgtggtg gatgccgacg
3301 agtacctcat cccacagcag ggcttcttca gcagcccctc cacgtcacgg actcccctcc
3361 tgagctctct gagtgcaacc agcaacaatt ccaccgtgpc ttgcattgat agaaatgggc
3421 tgcaaagctg tcccatcaag gaagacagct tcttgcagcg atacagctca gaccccacag
3481 gcgccttgac tgaggacagc atagacgaca ccttcctccc agtgcctggt gagtggcttg
3541 tctggaaaca gtcctgctcc tcaacctcct cgacccactc agcagcagcc agtctccagt
3601 gtccaagcca ggtgctccct ccagcatctc cagaggggga aacagtggca gatttgcaga
3661 cacagtgaag ggcgtaagga gcagataaac acatgaccga gcctgcacaa gctctttgtt
3721 gtgtctggtt gtttgctgta cctctgttgt aagaatgaat ctgcaaaatt tctagcttat
3781 gaagcaaatc acggacatac acatctgtgt gtgtgagtgt tcatgatgtg tgtacatctg
3841 tgtatgtgtg tgtgtgtatg tgtgtgtttg tgacagattt gatccctgtt ctctctgctg
3901 gctctacctt gacctgtgaa acgtatattt aactaattaa atattagtta atattaataa
3961 attttaagct ttatccagaa aaaaaaaaaa aaaa
```

SEQ ID NO: 102 Human EGFR Amino Acid Sequence Isoform F (NP_001333827.1)

```
   1 mrpsgtagaa llallaalcp asraleekkv cqgtsnkltq lgtfedhfls lqrmfnncev
  61 vlgnleityv qrnydlsflk tiqevagyvl ialntverip lenlqiirgn myyensyala
 121 vlsnydankt glkelpmrnl qeilhgavrf snnpalcnve siqwrdivss dflsnmsmdf
 181 qnhlgscqkc dpscpngscw gageencqkl tkiicaqqcs grcrgkspsd cchnqcaagc
 241 tgpresdclv crkfrdeatc kdtcpplmly npttyqmdvn pegkysfgat cvkkcprnyv
 301 vtdhgscvra cgadsyemee dgvrkckkce gpcrkvcngi gigefkdsls inatnikhfk
 361 nctsisgdlh ilpvafrgds fthtppldpq eldilktvke itgflliqaw penrtdlhaf
 421 enleiirgrt kqhgqtslav vslnitslgl rslkeisdgd viisgnknlc yantinwkkl
 481 fgtsgqktki isnrgensck atgqvchalc spegcwgpep rdcvscrnvs rgrecvdkcn
 541 llegeprefv enseciqchp eclpqamnit ctgrgpdnci qcahyidgph cvktcpagvm
 601 genntlvwky adaghvchlc hpnctygctg pglegcptng pkipsiatgm vgalllllvv
 661 algiglfmrr rhivrkrtlr rllqerelve pltpsgeapn qallrilket efkkikvlgs
 721 gafgtvykgl wipegekvki pvaikelrea tspkankeil deayvmasvd nphvcrllgi
 781 cltstvqlit qlmpfgclld yvrehkdnig sqyllnwcvq iakgmnyled rrlvhrdlaa
 841 rnvlvktpqh vkitdfglak llgaeekeyh aeggkvpikw malesilhri ythqsdvwsy
 901 gvtvwelmtf gskpydgipa seissilekg erlpqppict idvymimvkc wmidadsrpk
 961 freliiefsk mardpqrylv iqgdermhlp sptdsnfyra lmdeedmddv vdadeylipq
1021 qgffsspsts rtpllsslsa tsnnstvaci drnglqscpi kedsflqrys sdptgalted
1081 siddtflpvp gewlvwkqsc sstssthsaa aslqcpsqvl ppaspegetv adlqtq
```

SEQ ID NO: 103 Human EGFR cDNA Sequence Variant 7 (NM_001346899.1, CDS: from 258 to 3755)

```
   1 gtccgggcag ccccccgcgc agcgcggccg cagcagcctc cgcccccgc acgtgtgag
  61 cgcccgacgc ggccgaggcg gccggagtcc cgagctagcc ccggcggccg ccgccgccca
 121 gaccggacga caggccacct cgtcggcgtc cgcccgagtc cccgcctcgc cgccaacgcc
 181 acaaccaccg cgcacggccc cctgactccg tccagtattg atcgggagag ccggagcgag
 241 ctcttcgggg agcagcgatg cgaccctccg ggacggccgg ggcagcgctc ctggcgctgc
 301 tggctgcgct ctgcccggcg agtcgggctc tggaggaaaa gaaagtttgc caaggcacga
 361 gtaacaagct cacgcagttg ggcactttg aagatcattt ctcagcctc cagaggatgt
 421 tcaataactg tgaggtggtc cttgggaatt tggaaattac ctatgtgcag aggaattatg
 481 atctttcctt cttaaagacc atccaggagg tggctggtta tgtcctcatt gccctcaaca
 541 cagtggagcg aattcctttg gaaaacctgc agatcatcag aggaaatatg tactacgaaa
 601 attcctatgc cttagcagtc ttatctaact atgatgcaaa taaaaccgga ctgaaggagc
 661 tgcccatgag aaatttacag ggcaaaagt gtgatcaag ctgtcccaat gggagctgct
 721 ggggtgcagg agaggagaac tgcagaaac tgaccaaaat catctgtgcc cagcagtgct
 781 ccgggcgctg ccgtggcaag tcccccagtg actgctgcca accagtgt gctgcaggct
 841 gcacaggccc ccgggagagc gactgcctgg tctgccgcaa attccgagac gaagccacgt
 901 gcaaggacac ctgccccca ctcatgctct acaaccccac cacgtaccag atggatgtga
 961 accccgaggg caaatacagc tttggtgcca cctgcgtgaa gaagtgtccc cgtaattatg
1021 tggtgacaga tcacggctcg tgcgtccgag cctgtggggc cgacagctat gagatggagg
1081 aagacggcgt ccgcaagtgt aagaagtgcg aagggccttg ccgcaaagtg tgtaacggaa
1141 taggtattgg tgaatttaaa gactcactct cataaatgc tacgaatatt aaacacttca
1201 aaaactgcac ctccatcagt ggcgatctcc acatcctgcc ggtggcattt aggggtgact
1261 ccttcacaca tactcctcct ctggatccac aggaactgga tattctgaaa accgtaaagg
1321 aaatcacagg gttttttgctg attcaggctt ggcctgaaaa caggacggac ctccatgcct
1381 ttgagaacct agaaatcata cgcggcagga ccaagcaaca tggtcagttt tctcttgcag
1441 tcgtcagcct gaacataaca tccttgggat tacgctccct caaggagata agtgatggag
1501 atgtgataat tcaggaaac aaaatttgt gctatgcaaa tacaataaac tggaaaaaac
1561 tgtttgggac ctccggtcag aaaaccaaa ttataagcaa cagaggtgaa aacagctgca
1621 aggccacagg ccaggtctgc catgccttgt gctccccccga gggctgctgg ggcccggagc
1681 ccagggactg cgtctcttgc cggaatgtca gccgaggcag ggaatgtgta gacaagtgca
1741 accttctgga gggtgagcca agggagtttg tggagaactc tgagtgcata cagtgccacc
1801 cagagtgcct gcctcaggca atgaacatca cctgcacagg acgggaccca gacaactgta
1861 tccagtgtgc ccactacatt gacggccccc actgcgtcaa gacctgcccg gcaggagtca
1921 tgggagaaaa caacacctg gtctggaagt acgcagacgc cggccatgtg tgccacctgt
```

TABLE 1-continued

```
1981 gccatccaaa ctgcacctac ggatgcactg ggccaggtct tgaaggctgt ccaacgaatg
2041 ggcctaagat cccgtccatc gccactggga tggtggggc cctcctcttg ctgctggtgg
2101 tggccctggg gatcggcctc ttcatgcgaa ggcgccacat cgttcggaag cgcacgctgc
2161 ggaggctgct gcaggagagg gagcttgtgg agcctcttac acccagtgga gaagctccca
2221 accaagctct cttgaggatc ttgaaggaaa ctgaattcaa aaagatcaaa gtgctgggct
2281 ccggtgcgtt cggcacggtg tataagggac tctggatccc agaaggtgag aaagttaaaa
2341 ttcccgtcgc tatcaaggaa ttaagagaag caacatctcc gaaagccaac aaggaaatcc
2401 tcgatgaagc ctacgtgatg gccagcgtgg acaaccccca cgtgtgccgc ctgctgggca
2461 tctgcctcac ctccaccgtg cagctcatca cgcagctcat gcccttcggc tgcctcctgg
2521 actatgtccg ggaacacaaa gacaatattg ctcccagta cctgctcaac tggtgcgtgc
2581 agatcgcaaa gggcatgaac tacttggagg accgtcgctt ggtgcaccgc gacctggcag
2641 ccaggaacgt actggtgaaa acaccgcagc atgtcaagat cacagatttt gggctggcca
2701 aactgctggg tgcggaagag aaagaatacc atgcagaagg aggcaaagtg cctatcaagt
2761 ggatggcatt ggaatcaatt ttacacagaa tctatacccc accagagtgat gtctggagct
2821 acgggtgac tgtttgggag ttgatgacct ttggatccaa gccatatgac ggaatccctg
2881 ccagcgagat ctcctccatc ctggagaaag gagaacgcct ccctcagcca cccatatgta
2941 ccatcgatgt ctacatgatc atggtcaagt gctggatgat agacgcagat agtcgcccaa
3001 agttccgtga gttgatcatc gaattctcca aaatggcccg agaccccag cgctaccttg
3061 tcattcaggg ggatgaaaga atgcatttgc caagtcctac agactccaac ttctaccgtg
3121 ccctgatgga tgaagaagac atggacgacg tggtggatgc cgacgagtac ctcatcccac
3181 agcagggctt cttcagcagc ccctccacgt cacggactcc cctcctgagc tctctgagtg
3241 caaccagcaa caattccacc gtggcttgca ttgataagaaa tgggctgcaa agctgtccca
3301 tcaaggaaga cagcttcttg cagcgataca gctcagaccc cacaggcgcc ttgactgagg
3361 acagcataga cgacaccttc ctcccagtgc ctgaatacat aaaccagtcc gttcccaaaa
3421 ggcccgctgg ctctgtgcag aatcctgtct atcacaatca gcctctgaac cccgcgccca
3481 gcagagaccc acactaccag gaccccccaca gcactgcagt gggcaacccc gagtatctca
3541 acactgtcca gcccaccgtg tcaacagca cattcgacag ccctgcccac tgggcccaga
3601 aaggcagcca ccaaattagc ctggacaacc ctgactacca gcaggacttc tttccccaagg
3661 aagccaagcc aaatggcatc tttaagggct ccacagctga aatgcagaa tacctaaggg
3721 tcgcgccaca aagcagtgaa tttattggag catgaccacg gaggatagta tgagccctaa
3781 aaaatccgac tctttcgata cccaggacca agccacagca ggtcctccat cccaacagcc
3841 atgcccgcat tagctcttag acccacagac tggttttgca acgtttacac cgactagcca
3901 ggaagtactt ccacctcggg cacatttgg gaagttgcat tcctttgtct tcaaactgtg
3961 aagcatttac agaaacgcat ccagcaagaa tattgtccct ttgagcagaa atttattcttt
4021 caaagaggta tatttgaaaa aaaaaaaaag tatatgtgag gatttttatt gattggggat
4081 cttggagttt tcattgtcg ctattgattt tacttcaat gggctcttcc aacaaggaag
4141 aagcttgctg gtagcacttg ctaccctgag ttcatccagg cccaactgtg agcaaggagc
4201 acaagccaca agtcttccag aggatgcttg attccagtgg ttctgcttca aggcttccac
4261 tgcaaaacac taaagatcca agaaggcctt catggcccca gcaggccgga tcggtactgt
4321 atcaagtcat ggcaggtaca gtaggataag ccactctgtc ccttcctggg caaagaagaa
4381 acggagggga tggaattctt cctagactt acttttgtaa aaatgtcccc acggtactta
4441 ctccccactg atggaccagt ggtttccagt gatgagcgtt agactgactt gtttgtcttc
4501 cattccattg ttttgaaact cagtatgctg cccctgtctt gctgtcatga aatcagcaag
4561 agaggatgac acatcaaata ataactcgga ttccagccca cattggattc atcagcattt
4621 ggaccaatag cccacagctg agaatgtgga atacctaagg atagcaccgc ttttgttctc
4681 gcaaaaacgt atctcctaat ttgaggctca gatgaaatgc aacaggtcct ttggggcata
4741 gatcagaaga ctacaaaaat gaagctgctc tgaaatctcc tttagccatc accccaaccc
4801 cccaaaatta gtttgtgtta cttatggaag atagtttct ccttttactt cacttcaaaa
4861 gctttctact caaagagtat atgttccctc caggtcagct gccccaaaac cccctcctta
4521 cgctttgtca cacaaaagt gtctctgcct tgagtcatct attcaagcac ttacagctct
4981 ggccacaaca gggcatttta caggtgcgaa tgacagtagc attatgagta gtgtggaatt
5041 caggtagtaa atatgaaaact agggtttgaa attgataatg ctttcacaac atttgcagat
5101 gttttagaag gaaaaaagtt ccttcctaaa ataatttctc tacaattgga agattggaag
5161 attcagctag ttaggagccc accttttttc ctaatctgtg tgtgccctgt aacctgactg
5221 gttaacagca gtcctttgta aacagtgttt taaactctcc tagtcaatat ccaccccatc
5281 caatttatca aggaagaaat ggttcagaaa atattttcag cctacagtta tgttcagtca
5341 cacacacata caaaatgttc cttttgcttt taaagtaatt tttgactccc agatcagtca
5401 gagcccctac agcattgtta agaaagtatt tgattttgt ctcaatgaaa ataaaactat
5461 attcatttcc actctattat gctctcaaat acccctaagc atctatacta gcctggtatg
5521 ggtatgaaag atacaaagat aaataaaaca tagtccctga ttctaagaaa ttcacaattt
5581 agcaaaggaa atggactcat agatgctaac cttaaaacaa cgtgacaaat gccagacagg
5641 acccatcagc caggcactgt gagagcacag agcagggagg ttgggtcctg cctgaggaga
5701 cctggaaggg aggcctcaca ggaggatgac caggtctcag tcagcgggga ggtggaaagt
5761 gcaggtgcat caggggcacc ctgaccgagg aaacagctgc cagaggcctc cactgctaaa
5821 gtccacataa ggctgaggtc agtcacccta aacacctgc tccctaag ccaggggatg
5881 agcttggagc atcccacaag ttccctaaaa gttgcagccc caggggat tttgagctat
5941 catctctgca catgcttagt gagaagacta cacaacattt ctaagaatct gagattttat
6001 attgtcagtt aaccacttc attattcatt cacctcagga catgcagaaa tatttcagtc
6061 agaactggga aacagaagga cctacattct gctgtcactt atgtgtcaag aagcagatga
6121 tcgatgaggc aggtcagttg taagtgagtc acattgtagc attaaattct agtattttg
6181 tagtttgaaa cagtaactta ataaaagagc aaaagctaaa aaaaaaaaa aaaa
```

SEQ ID NO: 104 Human EGQFR Amino Acid Sequence Isoform G (NP_001333828.1)
```
  1 mrpsgtagaa llallaalcp asraleekkv cqgtsnkltq lgtfedhfls lqrmfnncev
 61 vlgnleityv qrnydlsflk tiqevagyvl ialntverip lenlqiirgn myyensyala
121 vlsnydankt glkelpmrnl qggkcdpscp ngscwgagee ncqkltkiic aqqcsgrcrg
181 kspsdcchnq caagctgpre sdclvcrkfr deatckdtcp plmlynptty qmdvnpegky
241 sfgatcvkkc prnyvvtdhg scvracgads yemeedgvrk ckkcegpcrk vcngigigef
301 kdslsinatn ikhfknctsi sgdlhilpva frgdsfthtp pldpqeldil ktvkeitgfl
361 liqawpenrt dlhafenlei irgrtkqhgq fslavvslni tslglrslke isdgdviisg
```

TABLE 1-continued

```
 421  nknlcyanti  nwkklfgtsg  qktkiisnrg  ensckatgqv  chalcspegc  wgpeprdcvs
 481  crnvsrgrec  vdkcnllege  prefvensec  iqchpeclpq  amnitctgrg  pdnciqcahy
 541  idgphcvktc  pagvmgennt  lvwkyadagh  vchlchpnct  ygctgpgleg  cptngpkips
 601  iatgmvgall  lllvvalgig  lfmrrrhivr  krtlrrllqe  relvepltps  geapnqallr
 661  ilketefkki  kvlgsgafgt  vykglwipeg  ekvkipvaik  elreatspka  nkeildeayv
 721  masvdnphvc  rllgicltst  vqlitqlmpf  gclldyvreh  kdnigsqyll  nwcvqiakgm
 781  nyledrrlvh  rdlaarnvlv  ktpqhvkitd  fglakllgae  ekeyhaeggk  vpikwmales
 841  ilhriythqs  dvwsygvtvw  elmtfgskpy  dgipaseiss  ilekgerlpq  ppictidvym
 901  imvkcwmida  dsrpkfreli  iefskmardp  qrylviqgde  rmhlpsptds  nfyralmdee
 961  dmddvvdade  ylipqqgffs  spstsrtpll  sslsatsnns  tvacidrngl  qscpikedsf
1021  lqryssdptg  altedsiddt  flpvpeyinq  svpkrpagsv  qnpvyhnqpl  npapsrdphy
1081  qdphstavgn  peylntvqpt  cvnstfdspa  hwaqkgshqi  sldnpdyqqd  ffpkeakpng
1141  ifkgstaena  eylrvapqss  efiga
```

SEQ ID NO: 105 Human EGFR cDNA Sequence Variant 8 (NM_001346900.1, CDS: from 214 to 3687)

```
   1  cctttttgaat  gagctctaaa  acagttctcc  actggacttc  agaacaagag  ggagctctgg
  61  gctgctggct  ggttgtgcat  ttgctgtggg  ttccccccgg  caggcgacct  ctccgcgctg
 121  agaaggttat  ccggataacc  aatttgccaa  ggcacgagta  acaagctcac  gcagttgggc
 181  acttttgaag  atcatttcct  cagcctccag  aggatgttca  ataactgtga  ggtggtcctt
 241  gggaatttgg  aaattaccta  tgtgcagagg  aaattatgat  tttccttctt  aaagaccatc
 301  caggaggtgg  ctggttatgt  cctcattgcc  ctcaacacag  tggagcgaat  tcctttggaa
 361  aacctgcaga  tcatcagagg  aaatatgtac  tacgaaaatt  cctatgcctt  agcagtctta
 421  tctaactatg  atgcaaataa  aaccggactg  aaggagctgc  catgagaaa  tttacaggaa
 481  atcctgcatg  gcgccgtgcg  gttcagcaac  aaccctgccc  tgtgcaacgt  ggagagcatc
 541  cagtggcggg  acatagtcag  cagtgacttt  ctcagcaaca  tgtcgatgga  cttccagaac
 601  cacctgggca  gctgccaaaa  gtgtgatcca  agctgtccca  atgggagctg  ctggggtgca
 661  ggagaggaga  actgccagaa  actgaccaaa  accatctgtg  cccagcagtg  ctccgggcgc
 721  tgccgtggca  agtcccccag  tgactgctgc  cacaaccagt  gtgctgcagg  ctgcacaggc
 781  cccgggaga  gcgactgcct  ggtctgccgc  aaattccgaa  acgaagccac  gtgcaaggac
 841  acctgccccc  cactcatgct  ctacaacccc  accacgtacc  agatggatgt  gaaccccgag
 901  ggcaaataca  gctttggtgc  cacctgcgtg  aagaagtgtc  ccgtaatta  tgtggtgaca
 961  gatcacgct  cgtgcgtccg  agcctgtggg  ccgacagct  atgagatgga  ggaagacggc
1021  gtccgcaagt  gtaagaagtg  cgaagggcct  tgccgcaacag  tgtgtaacgg  aataggtatt
1081  ggtgaattta  aagactcact  ctccataaat  gctacgaata  ttaaacactt  caaaaactgc
1141  acctccatca  gtggcgatct  ccacatcctg  ccggtggcat  ttaggggtga  ctccttcaca
1201  catactcctc  ctctggatcc  acaggaactg  gatattctga  aaaccgtaaa  ggaaatcaca
1261  gggttttttgc  tgattcaggc  ttggcctgaa  aacaggacgg  acctccatgc  ctttgagaac
1321  ctagaaatca  tacgcggcag  gaccaagcaa  catggtcagt  tttctcttgc  agtcgtcagc
1381  ctgaacataa  catccttggg  attacgctcc  ctcaaggaga  taagtgatgg  agatgtgata
1441  atttcaggaa  acaaaaattt  gtgctatgca  aatacaataa  actggaaaaa  actgtttggg
1501  acctccggtc  agaaaaccaa  aattataagc  aacagaggtg  aaaacagctg  caaggccaca
1561  ggccaggtct  gccatgcctt  gtgctccccc  gagggctgct  ggggcccgga  gcccagggac
1621  tgcgtctctt  gccggaatgt  cagccgaggc  agggaatgcg  tggacaagtg  caaccttctg
1681  gagggtgagc  caagggagtt  tgtggagaac  tctgagtgca  tacagtgcca  cccagagtgc
1741  ctgcctcagg  ccatgaacat  cacctgcaca  ggacggggac  cagacaactg  tatccagtgt
1801  gcccactaca  ttgacggccc  ccactgcgtc  aagacctgcc  cggcaggagt  catgggagaa
1861  aacaacaccc  tggtctggaa  gtacgcagac  gccggccatg  tgtgccacct  gtgccatcca
1921  aactgcacct  acggatgcac  tgggccaggt  cttgaaggct  gtccaacgaa  tgggcctaag
1981  atcccgtcca  tcgccactgg  gatggtgggg  gccctcctct  tgctgctggt  ggtggcctg
2041  gggatcggcc  tcttcatgcg  aaggcgccac  atcgttcgga  agcgcacgct  gcggaggctg
2101  ctgcaggaga  gggagcttgc  ggagcctctt  acacccagtg  agaagctcc  caaccaagct
2161  ctcttgagga  tcttgaagga  aactgaattc  aaaaagatca  aagtgctggg  ctccggtgcg
2221  ttcggcacgg  tgtataaggg  actctctggatc  ccagaaggtg  agaaagttaa  aattcccgtc
2281  gctatcaagg  aattaagaga  agcaacatct  ccgaaagcca  acaaggaaat  cctcgatgaa
2341  gcctacgtga  tggccagcgt  ggacaacccc  cacgtgtgcc  gcctgctggg  catctgcctc
2401  acctccaccg  tgcagctcat  cacgcagctc  atgcccttcg  gctgcctcct  ggactatgtc
2461  cgggaacaca  aagacaatat  tggctcccag  tacctgctca  actggtgtgt  gcagatcgca
2521  aagggcatga  accacttgga  ggaccgtcgc  ttggtgcacc  gcgacctggc  agccaggaac
2581  gtactggtga  aaacaccgca  gcatgtcaag  atcacagatt  ttgggctggc  caaactgctg
2641  ggtgcggaag  agaaagaata  ccatgcagaa  ggaggcaaag  tgcctatcaa  gtggatgcga
2701  ttggaatcaa  ttttacacag  aatctatacc  caccagagtg  atgtctggag  ctacggggtg
2761  actgttttggg  agttgatgac  ctttgatcc  agccatatg  acggaatccc  tgccagcgag
2821  atctcctcca  tcctggagaa  aggagaacgc  ctccctcagc  cacccatatg  taccatcgat
2881  gtctacatga  tcatggtcaa  gtgctggatg  atagacgcag  atagtcgccc  aaagttccgt
2941  gagttgatca  tcgaattctc  caaaatggcc  cgagacccc  agcgctacct  tgtcattcag
3001  ggggatgaaa  gaatgcattt  gccaagtcct  acagactcca  acttctacg  tgccctgatg
3061  gatgaagaag  acatggacga  cgtggtggat  gccgacgagt  acctcatccc  acagcagggc
3121  ttcttcagca  gccccctcca  gtcacggact  ccctcctga  gtctctgag  tgcaaccagc
3181  aacaattcca  ccgtggcttg  cattgataga  aatgggctgc  aaagctgtcc  catcaaggaa
3241  gacagcttct  tgcagcgata  cagctcagac  cccacaggcc  ccttgactga  agacagcata
3301  gacgacacct  tcctcccagt  gcctgaatac  ataaaccagt  ccgttcccaa  aggcccgct
3361  ggctctgtgc  agaatcctgt  ctatcacaat  cagcctctga  accccgcgcc  cagcagagac
3421  ccacactacc  aggaccccca  cagcactgca  gtgggcaacc  ccgagtatct  caacactgtc
3481  cagccccact  gtgtcaacag  cacattcgac  agccctgccc  actgggcca  gaaaggcagc
3541  caccaaatta  gcctggacaa  ccctgactac  cagcaggact  tctttccaa  ggaagccaag
3601  ccaaatggca  tctttaaggg  ctccacagct  gaaaatgcag  aatacctaag  ggtcgcgcca
3661  caaagcagtg  aatttattgg  agcatgacca  cggaggatag  tatgagccct  aaaaatccag
3721  actctttcga  tacccaggac  caagccacag  caggtcctcc  atcccaacag  ccatgcccgc
3781  attagctctt  agacccacag  actggttttg  caacgtttac  accgactagc  caggaagtac
```

TABLE 1-continued

```
3841 ttccacctcg ggcacatttt gggaagttgc attccttttgt cttcaaactg tgaagcattt
3901 acagaaacgc atccagcaag aatattgtcc ctttgagcag aaatttatct ttcaaagagg
3961 tatatttgaa aaaaaaaaaa agtatatgtg aggatttta ttgattgggg atcttggagt
4021 ttttcatcgt cgctattgat ttttacttca atgggctctt ccaacaagga agaagcttgc
4081 tggtagcact tgctaccctg agttcatcca ggcccaactg tgagcaagga gcacaagcca
4141 caagtcttcc agaggatgct tgattccagt ggttctgctt caaggcttcc actgcaaaac
4201 actaaagatc caagaaggcc ttcatggccc cagcaggccg gatcggtact gtatcaagtc
4261 atggcaggta cagtaggata agccactctg tcccttcctg ggcaaagaag aaacggaggg
4321 gatggaattc ttccttagac ttacttttgt aaaaatgtcc ccacggtact tactccccac
4381 tgatggacca gtggtttcca gtcatgagcg ttagactgac ttgtttgtct tccattccat
4441 tgttttgaaa ctcagtatgc tgcccctgtc ttgctgtcat gaaatcagca agagaggatg
4501 acacatcaaa taataactcg gattccagcc cacattggat tcatcagcat ttggaccaat
4561 agcccacagc tgagaatgtg gaatacctaa ggatagcacc gcttttgttc tcgcaaaaac
4621 gtatctccta atttgaggct cagatgaaat gcatcaggtc ctttggggca tagatcagaa
4681 gactacaaaa atgaagctgc tctgaaatct cctttagcca tcaccccaac cccccaaaat
4741 tagtttgtgt tacttatgga agatagtttt ctcctttac ttcacttcaa aagcttttta
4801 ctcaaagagt atatgttccc tccaggtcag ctgccccaa acccctcct tacgcttttgt
4861 cacacaaaaa gtgtctctgc cttgagtcat ctattcaagc acttacagct ctggccacaa
4921 cagggcattt tacaggtgcg aatgacagta gcattatgag tagtgtggaa ttcaggtagt
4981 aaatatgaaa ctagggtttg aaattgataa tgctttcaca acatttgcag atgttttaga
5041 aggaaaaaag ttccttccta aaacaatttc tctacaattg gaagattgga agattcagct
5101 agttaggagc ccaccttttt tcctaatctg tgtgtgccct gtaacctgac tggttaacag
5161 cagtcctttg taaacgtgt tttaaactct cctagtcaat atccacccca tccaatttat
5221 caaggaagaa atggttcaga aaatattttc agcctacagt tatgttcagt cacacacaca
5281 tacaaaatgt tccttttgct tttaaagtaa ttttttgact ccagatcagt cagagcccct
5341 acagcattgt taagaaagta tttgatttt gtctcaatga aaataaaact atattcattt
5401 ccactctatt atgctctcaa atacccctaa gcatctatc tagcctggta tgggtatgaa
5461 agatacaaag ataaataaaa catagtccct gattctaaga aattcacaat ttagcaaagg
5521 aaatggactc atagatgcta acctaaaac aacgtgacaa atgacacaga ggacccatca
5581 gccaggcact gtgagagcac agagcaggga ggttgggtcc tgcctgagga gacctggaag
5641 ggaggcctca caggaggatg accaggtctc agtcagcggg gaggtggaaa gtgcaggtgc
5701 atcaggggca ccctgaccga ggaaacagct gccagaggcc tccactgcta aagtccacat
5761 aaggctgagg tcagtcaccc taaacaacct gctccctcta agccagggga tgagcttgga
5821 gcatcccaca agttccctaa aagttgcagc ccccaggggg attttgagct atcatctctg
5881 cacatgctta gtgagaagac tacacaacat ttctaagaat ctgagatttt atattgtcag
5941 ttaaccactt tcattattca ttcacctcag gacatgcaga aatatttcag tcagaactgg
6001 gaaacagaag gacctacatt ctgctgtcac ttatgcgtca agaagcagat gatcgatgag
6061 gcaggtcagt tgtaagtgag tcacattgta gcattaaatt ctagtatttt tgtagtttga
6121 aacagtaact taataaaaga gcaaaagcta aaaaaaaaaa aaaaaa
```

SEQ ID NO: 106 Human EGFR Amino Acid Sequence Isoform H (NP_001333829.1)

```
   1 mfnncewlg nleityvqrn ydlsflktiq evagyvlial ntveriplen lqiirgnmyy
  61 ensyalavls nydanktglk elpmrnlqei lhgavrfsnn palcnvesiq wrdivssdfl
 121 snmsmdfqnh igscqkcdps cpngscwgag eenncqkltki icaqqcsgrc rgkspsdcch
 181 nqcaagctgp resdclvcrk frdeatckdt cpplmlynpt tyqmdvnpeg kysfgatcvk
 241 keprnyvvtd hgscvracga dsyemeedgv rkckkccegpc rkvengigig efkdslsina
 301 tnikhfknct sisgdlhilp vafrgdsfrh tppldpqeld ilktvkeitg flliqawpen
 361 rtdlhafenl eiirgrtkqh gqfslavvsl nitslglrsl keisdgdvii sgnknlcyan
 421 tinwkklfgt sgqktkiisn rgensckatg qvchalcspe gcwgpeprdc vscrnvsrgr
 481 ecvdkcnlle geprefvens eciqchpecl pqamnitctg rgpdnciqca hyidgphcvk
 541 tcpagvmgen ntlvwkyada ghvchlchpn ctygctgpgl egcptngpki psiatgmvga
 601 llllllvvalg iglfmrrrhi vrkrtlrrll qerelveplt psgeapnqal lrilketefk
 661 kikvlgsgaf gtvykglwip egekvkipva ikelreatsp kankeildea yvmasvdnph
 721 vcrllgiclt stvqlitqlm pfgclldyvr ehkdnigsqy llnwcvqiak gmnyledrrl
 781 vhrdlaarnv lvktpqhvki tdfglaklig aeeekeyhaeg gkvpikwmal esilhriyth
 841 qsdvwsygvt vwelmtfgsk pydgipasei ssilekgerl pqppictidv ymimvkcwmi
 901 dadsrpkfre liiefskmar dpqrylviqg dermhlpspt dsnfyralmd eedmddvvda
 961 deylipqqgf fsspstsrtp llsslsatsn nstvacidrn glqscpiked sflqryssdp
1021 tgaltedsid dtflpveyi nqsvpkrpag svqnpvyhnq plnpapsrdp hyqdphstav
1081 gnpeylncvq ptcvnscfds pahwaqkgsh qisldnpdyq qdffpkeakp ngifkgstae
1141 naeylrvapq ssefiga
```

SEQ ID NO: 107 Human EGFR cDNA Sequence Variant 9 (NM_001346941.1, CDS: from 258 to 3089)

```
   1 gtccgggcag ccccccggcgc agcgcggccg cagcagcctc cgccccccgc acggtgtgag
  61 cgcccgacgc ggccgaggcg gccggagtcc cgagctagcc ccggcggccg ccgccgccca
 121 gaccggacga caggccacct cgtcggcgtc cgcccgatcc cccgcctcgc cgccaacgcc
 181 acaaccaccg cgcacgcccc cctgactccg tccagtattg atcgggagag ccggagcgag
 241 ctcttcgggg agcagcgatg cgaccctccg gacggccgg ggcagcgctc ctggcgctgc
 301 tggctgcgct ctgcccggca gtcgggctc tggaggaaaa gaaaggtaat tatgtggtga
 361 cagatcacgg ctcgtgcgtg cgagcctgtg gggccgacag ctatgagatg gaggaagacg
 421 gcgtccgcaa gtgtaagaag tgcgaagggc cttgccgcaa agtgtgtaac ggaataggta
 481 ttggtgaatt taaagactca ctctccataa atgctacgaa tactaaacac ttcaaaaact
 541 gcacctccat cagtggcgat ctccacatcc tgccggtggc atttaggggt gactcctcca
 601 cacatactcc tcctctggat ccacaggaac tggatattct gaaaaccgta aaggaaatca
 661 cagggttttt gctgattcag gcttggcctg aaaacaggac ggacctccat gcctttgaga
 721 acctagaaat catacgcggc aggaccaagc aacatggtca gttttctctt gcagtcgtca
 781 gcctgaacat aacatccttg ggattacgct ccctcaagga gataagtgat ggagatgtga
 841 taatttcagg aaacaaaaat ttgtgctatg caaatacaat aaactggaaa aaactgtttg
 901 ggacctccgg tcagaaaacc aaaattataa gcaacagagg tgaaaacagc tgcaaggcca
```

TABLE 1-continued

```
 961 caggccaggt ctgccatgcc ttgtgctccc ccgagggctg ctggggcccg gagcccaggg
1021 actgcgtctc ttgccggaat gtcagccgag gcagggaatg cgtggacaag tgcaaccttc
1081 tggagggtga gccaagggag tttgtggaga actctgagtg catacagtgc cacccagagt
1141 gcctgcctca ggccatgaac atcacctgca caggacgggg accagacaac tgtatccagt
1201 gtgcccacta cattgacggc ccccactgcg tcaagacctg cccggcagga gtcatgggag
1261 aaaacaacac cctggtccgg aagtacgcag acgccggcca tgtgtgccac ctgtgccacc
1321 caaactgcac ctacgcgatgc actgggccag gtcttgaagg ctgtccaacg aatgggccta
1381 agatcccgtc catcgccact gggatggtgg gggccctcct cttgctgctg gtggtggccc
1441 tggggatcgg cctcttcatg cgaaggcgcc acatcgttcg gaagcgcacg ctgcggaggc
1501 tgctgcagga gagggagctt gtggagcctc ttacacccag tggagaagct cccaaccaag
1561 ctctcttgag gatcttgaag gaaactgaat tcaaaaagat caaagtgctg ggctccggtg
1621 cgttcggcac ggtgtataag ggactctgga tcccagaagg tgagaaagtt aaaattcccg
1681 tcgctatcaa ggaattaaga gaagcaacat ctccgaaagc caacaaggaa atcctcgatg
1741 aagcctacgt gatggccagc gtggacaacc ccacgtgtg ccgcctgctg ggcatctgcc
1801 tcacctccac cgtgcagctc atcacgcagc tcatgccctt cggctgcctc ctggactatg
1861 tccgggaaca caaagacaat attggctccc agtacctgct caactggtgt gtgcagatcg
1921 caaagggcat gaactacttg gaggaccgtc gcttggtgca ccgcgacctg gcagccagga
1981 acgtactggt gaaaacaccg cagcatgtca agatcacaga ttttgggctg gccaaactgc
2041 tgggtgcgga agagaaagaa taccatgcag aaggaggcaa agtgccatc aagtggatgg
2101 cattggaatc aattttacac agaatctata cccaccagag tgatgtctgg agctacgggg
2161 tgactgtttg ggagttgatg accttttggat ccaagccata tgacggaatc cctgccagcg
2221 agatctcctc catcctggag aaaggagaac gcctccctca gccacccata tgtaccatcg
2281 atgtctacat gatcatggtc aagtgctgga tgatagacgc agatagtcgc ccaaagttcc
2341 gtgagttgat catcgaattc tccaaaatgg cccgagaccc cagcgctac cttgtcattc
2401 aggggatga aagaatgcat ttgccaagtc ctacagactc caacttctac cgtgccctga
2461 tggatgaaga agacatggac gacgtggtgg atgccgacga gtacctcatc ccacagcagg
2521 gcttcttcag cagccccctcc acgtcacgga ctcccctcct gagctctctg agtgcaacca
2581 gcaacaattc caccgtggct tgcattgata gaaatgggct gcaaagctgt cccatcaagg
2641 aagacagctt cttgcagcga tacagctcag accccacagg cgccttgact gaggacagca
2701 tagacgacac cttcctccca gtgcctgaat acataaacca gtccgttccc aaaaggcccg
2761 ctggctctgt gcagaatcct gtctatcaca atcagcctct gaaccccgcg cccagcagag
2821 acccacacta ccaggacccc cacagcactg cagtgggcaa ccccgagtat ctcaacactg
2881 tccagcccac ctgtgtcaac agcacattcg cagccctgc ccactgggcc cagaaaggca
2941 gccaccaaat tagcctggac aaccctgact accagcagga cttctttccc aaggaagcca
3001 agccaaatgg catctttaag ggctccacag ctgaaaatgc agaataccta agggtcgcgc
3061 cacaaagcag tgaatttatt ggagcatgac cacggaggat agtatgagcc ctaaaaatcc
3121 agactctttc gatacccagg accaagccac agcaggtcct ccatcccaac agccatgccc
3181 gcattagctc ttagacccag agactggttt tgcaacgttt acaccgacta gccaggaagt
3241 acttccacct cgggcacatt ttgggaagtt gcattccttt gtcttcaaac tgtgaagcat
3301 ttacagaaac gcatccagca agaatattgt cccctttgagc agaaatttat cttttcaaaga
3361 ggtatatttg aaaaaaaaaa aaagtatatg tgaggatttt tattgattgg ggatcttgga
3421 gttttcatt gtcgctattg attttactt caatgggctc ttccaacaag gaagaagctt
3481 gctggtagca cttgctaccc tgagttcatc caggcccaac tgtgagcaag gagcacaagc
3541 cacaagtctt ccagaggatg cttgattcca gtggttctgc ttcaaggctt ccactgcaaa
3601 acactaaaga tccaagaagg ccttcatggc ccagcaggc cggatcggta ctgtatcaag
3661 tcatggcagg tacagtagga taagccactc tgtcccttcc tgggcaaaga agaaacggag
3721 gggatggaat tcttccttag acttactttt gtaaaaatgt ccccacggta cttactcccc
3781 actgatggac cagtggtttc cagtcatgag cgttagactg acttgtttgt cttccattcc
3841 attgttttga aactcagtat gctgccctg tcttgctgtc atgaaatcag caagagagga
3901 tgacacatca aataataact cggattccag cccacattgg attcatcagc atttggacca
3961 atagcccaca gctgagaatg tggaatacct aaggatagca ccgcttttgt tctcgcaaaa
4021 acgtatctcc taatttgagg ctcagatgaa atgcatcagt tctttcgggg catagatcag
4081 aagactacaa aaatgaagct gctctgaaat ctcctttagc catcacccca accccccaaa
4141 attagtttgt gttacttatg gaagatagtt ttctcctttt acttcacttc aaaagctttt
4201 tactcaaaga gtatatgttc cctccaggtc agctgccccc aaaccccctc cttacgcttt
4261 gtcacacaaa agtgtctct gccttgagtc atctattcaa gcacttacag ctctggccac
4321 aacagggcat tttacaggtg cgaatgacag tagcattatg gtagtgtgg aattcaggta
4381 gtaaatatga aactagggtt tgaaattgat aatgctttca caacatttgc agatgtttta
4441 gaaggaaaaa agctccttcc taaaataatt tctctacaat tggaagattg gaagattcag
4501 ctagttagga gcccaccttt tttcctaatc tgtgtgtgcc ctgtaacctg actggttaac
4561 agcagtcctt tgtaaacagt gttttaaact ctcctagtca atatccaccc catccaattt
4621 atcaaggaag aaatggttca gaaaatattt tcagcctaca gttatgttca gtcacacaca
4681 catacaaaat gttccttttg cttttaaagt aattttttgac tccagatca gtcagagccc
4741 ctacagcact gttaagaaag tatttgattt ttgtctcaat gaaaataaaa ctatattcat
4801 ttccactcta ttatgctctc aaatacccct aagcatctat actagcctgg tatgggtatg
4861 aaagatacaa agataaataa aacatagtcc ctgattctaa gaaattcaca atttagcaaa
4921 ggaaatggac tcatagatgc taaccttaaa acaacgtgac aaatgccaga caggacccat
4981 cagccaggca ctgtgagagc acagagcagg gaggttgggt cctgcctgag gagacctgga
5041 agggaggcct cacaggagga tgaccaggtc tcagtcagcg ggaggtgga aagtgcaggt
5101 gcatcagggg caccctgacc gaggaaacag ctgccagagg cctccactgc taaagtccac
5161 ataaggctga ggtcagtcac cctaaacaac ctgctccctc taagccaggg gatgagcttg
5221 gagcatccca caagttccct aaaagttgca gccccagggg ggatttcgag ctatcatctc
5281 tgcacatgct tagtgagaag actacacaac atttctaaga atctgagatt ttatattgtc
```

TABLE 1-continued

```
5341 agttaaccac tttcattatt cattcacctc aggacatgca gaaatatttc agtcagaact
5401 gggaaacaga aggacctaca ttctgctgtc acttatgtgt caagaagcag atgatcgatg
5461 aggcaggtca gttgtaagtg agtcacattg tagcattaaa ttctagtatt tttgtagttt
5521 gaaacagtaa cttaataaaa gagcaaaagc ta
```

SEQ ID NO: 108 Human EGFR Amino Acid Sequence Isoform I (NP_001333870.1)

```
  1 mrpsgtagaa llallaalcp asraleekkg nyvvtdhgsc vracgadsye meedgvrkck
 61 kcegpcrkvc ngigigefkd slsinatnik hfknctsisg dlhilpvafr gdsfthtppl
121 dpqeldilkt vkeitgflli qawpenrtdl hafenleiir grtkqhgqfs lavvslnits
181 lglrslkeis dgdviisgnk nlcyantinw kklfgtsgqk tkiisnrgen sckatgqvch
241 alcspegcwg peprdcvscr nvsrgrecvd kcnllegepr efvenseciq chpeclpqam
301 nitctgrgpd nciqcahyid gphcvktcpa gvmgenntlv wkyadaghvc hlchpnctyg
361 ctgpglegcp tngpkipsia tgmvgalll lvvalgiglf mrrrhivrkr tlrrllqere
421 lveplptsge apnqallril kerefkkikv lgsgafgtvy kglwipegek vkipvaikel
481 reatspkank eildeayvma svdnphvcrl lgicltstvq litqlmpfgc lldyvrehkd
541 nigsqyllnw cvqiakgmny ledrrlvhrd laarnvlvkt pqhvkitdfg lakllgaeek
601 eyhaeggkvp ikwmalesil hriythqsdv wsygvtvwel mtfgskpydg ipaseissil
661 ekgerlpqpp ictidvymim vkcwmidads rpkfreliie fskmardpqr ylviqgderm
721 hlpsptdsnf yralmdeedm ddvvdadeyl ipqqgffssp stsrtpllss lsatsnnstv
781 acidrnglqs cpikedsflq ryssdptgal tedsiddtfl pvpeyinqsv pkrpagsvqn
841 pvyhnqplnp apsrdphyqd phstavgnpe ylntvqptcv nstfdspahw aqkgshqisl
901 dnpdyqqdff pkeakpngif kgstaenaey lrvapqssef iga
```

SEQ ID NO: 109 Mouse EGFR cDNA Sequence Variant 1 (NM_207655.2, CDS: from 281 to 3913)

```
   1 ctcccccagc cccgacccga gctaactaga cgtctgggca gccccagcgc aacgcgcagc
  61 agcctccctc ctcttcttcc cgcactgtgc gctcctcctg ggctagggcg tctggatcga
 121 gtcccggagg ctaccgcctc ccagacagac gacaggtcac ctggacgcga gcctgtgtcc
 181 gggtctcgtc gttgccggcg cagtcactgg gcacaaccgt gggactccgt ctgtctcgga
 241 ttaatcccgg agagccagag ccaacctctc ccggtcagag atgcgaccgc cagggaccgc
 301 gagaaccaca ctgctggtgt tgctgaccgc gctctgcgcc gcaggtgggg cgttggagga
 361 aaagaaagtc tgccaaggca caagtaacag gctcacccaa ctgggcactt tgaagacca
 421 cttttctgagc ctgcagagga tgtacaacaa ctgtgaagtg gtccttggga acttggaaat
 481 tacctatgtg caaaggaatt acgacctttc cttcttaaag accatccagg aggtggccag
 541 ctatgtcctc attgccctca acaccgtgga gagaatccct ttggagaacc tgcagatcat
 601 caggggaaat gctctttatg aaaacaccta tgccttagcc atcccgtcca actatgggac
 661 aaacagaact gggcttaggg aactgcccat gcggaactta caggaaatcc tgattggtgc
 721 tgtgcgattc agcaacaacc ccatcctctg caatatgcgat actatccagt ggaggggacat
 781 cgtccaaaac gtctttatga gcaacatgtc aatggactta cagagccatc cgagcagttg
 841 ccccaaatgt gatccaagct gtcccaatgg aagctgctgg gaggaggag aggagaactg
 901 ccagaaattg accaaaatca tctgtgccca gcaatgttcc catcgctgtc gtggcaggtc
 961 ccccagtgac tgctgccaca accaatgtgc tgcggggtgt acagggcccc gagagagtga
1021 ctgtctggtc tgccaaaagt tccaagatga ggccacatgc aaagacacct gcccaccact
1081 catgctgtac aaccccacca cctaccagat ggatgtcaac cctgaaggga agtacagctt
1141 tggtgccacc tgtgtgaaga agtgccccg aaactacgtg gcgacagatc atgctcatg
1201 tgtccgagcc tgtgggcctg actactacga agtggaagaa gatggcatcc gcaagtgtaa
1261 aaaatgtgat gggccctgtc gcaaagtttg taatggcata ggcattggtg aacttaaaga
1321 cacactctcc ataaatgcta caaacatcaa acacttcaaa tactgcactg ccatcagcgg
1381 ggaccttcac atcccgccaa tggccttttaa gggggattct ttcacgcgca ctcctcctct
1441 agacccacga gaactagaaa ttctcaaaaac cgtaaaggaa ataacagctc ttttgctgat
1501 tcaggcttgg cctgataact ggactgacct ccatgctttc gagaacctag aaataatacg
1561 tggcagaaca aagcaacatg gtcagttttc tttgcggtc gttggcctga acatcacatc
1621 actggggctg cgttccctca aggagatcag tgatgggat gtgatcattt ctggaaaccg
1681 aaatttgtgt acgcaaaaca caatcaaactg gaaaaactc ttcgggacac ccaatcagaa
1741 aaccaaaatc atgaacaaca gagctgagaa agactgcaag gccgtgaacc acgtctgcaa
1801 tcctttatgc tcctcggaag gctgctgggg ccctgagccc agggactgtg tctcctgcca
1861 gaatgtgagc agaggcaggg agtgcgtgga gaatgcaac atcctggagg gggaaccaag
1921 ggagtttgtg gaaaattctg aatgcatcca gtgccatcca gaatgtctgc ccaggccat
1981 gaacatcacc tgtacaggca ggggaccaga caactgcatc cagtgtgccc actacattga
2041 tggcccacac tgtgtcaaga cctgcccagc tggcatcatg ggagagaaca cactctggt
2101 ctggaagtat gcagatgcca ataatgtctg ccacctgtgc cacgccaact gtacctatgg
2161 atgtgctggg ccaggtcttc aaggatgtga agtgtggcca tctgggccaa agataccatc
2221 tattgccact gggattgtgg gtgcctcct cttcatagtg gtggtgccc ttggggattgg
2281 cctattcatg cgaagacgtc acattgttcg aaagcgtaca ctacgcgcc tgcttcaaga
2341 gagagagctc gtggaacctc tcacacccag cggagaagct ccaaaccaag cccacttgag
2401 gatattaaag gaaacagaat tcaaaaagat caagttctg ggttcgggag catttggcac
2461 agtgtataag ggtctctgga cccagaagg tgagaaagta aaaatcccgg tggccatcaa
2521 ggagttaaga gaagccacat ctccaaaagc caacaaagaa atccttgacg aagcctatgt
2581 gatggctagt gtggacaacc ctcatgtatg ccgcctcctg gcatctgtc tgacctccac
2641 tgtccagctc attacacagc tcatgcccta cggttgcctc ctggactacg tccgagaaca
2701 caaggacaac attggctccc agtacctcct caactggtgt gtgcagattg caaagggcat
2761 gaactacctg gaagatcggc gtttggtgca ccgtgacttg gcagcagga atgtactggt
2821 gaagacacca cagcatgtca agatcacaga ttttgggctg ccaaactgc ttggtgctga
2881 agagaaagaa tatcatgccg aggggggcaa agtgcctatc aagtggatgg ctttggaatc
2941 aattttacac cgaatttaca cacaccaaag tgatgtggg agctatgtg tcactgtctg
3001 ggaactgatg acctttgggt ccaagcctta tgatggaatc ccagcaagtg acatctcatc
3061 catcctgag aaaggagagc gccttccaca gccacctatc tgcaccatcg atgtctacat
3121 gatcatggtc aagtgctgga tgatagatgc tgatagccgc ccaaagttcc gagagttgat
3181 tcttgaattc tccaaaatgg cccgagaccc acagcgctac cttgttatcc aggggatga
3241 aagaatgcat ttgccaagcc ctacagactc caactttac cgagccctga tggatgaaga
```

TABLE 1-continued

```
3301  ggacatggag gatgtagttg atgctgatga gtatcttatc ccacagcaag gcttcttcaa
3361  cagcccgtcc acgtcgagga ctccctctt gagttctctg agtgcaacta gcaacaattc
3421  cactgtggct tgcattaata gaaatgggag ctgccgtgtc aaagaagacg ccttcttgca
3481  gcggtacagc tccgacccca caggtgctgt aacagaggac aacatagatg acgcattcct
3541  ccccgtacct gaatatgtaa accaatctgt tcccaagagg ccagcaggct ctgtgcagaa
3601  ccctgtctat cacaatcagc cctgcatcc agctcctgga agagacctgc attatcaaaa
3661  tccccacagc aatgcagtgg gcaaccctga gtatctcaac actgcccagc ctacctgtct
3721  cagcagtggg tttaacagcc ctgcactctg gatccagaaa ggcagtcacc aaatgagcct
3781  agacaaccct gactaccagc aggacttctt ccccaaggaa accaagccaa atggcatatt
3841  taagggcccc acagctgaaa atgcagagta cctacggggtg gcacctccaa gcagtgagtt
3901  tattggagca tgacaagaag gggcatcata ccagctataa aatgtctgga cttctagaa
3961  tcccaggacc aactatggca gcacctccac ttctggtagc catgcccacg ctgtgtcaaa
4021  tgtcactcag actggcttta aagcataact ctgatgggct ttgtcactga gccaagaagt
4081  gggcctctct cctgatgcac tttgggaagt tgaaggtaca tcaattgatc ttcgaactgt
4141  gaagattcca caaaaaaggt atccatcgag aacattgtcc attggaacag aagtttgcct
4201  catggtgagg tacatatggg aaaaaaacag acatatggag cttatattta gggaactttg
4261  ggattcttgt ctttattgat ttgattgatg cactcttgta gtctggtaca cagagttgcc
4321  tggagccaac tgaccagaca gttggttcca ccagctctgc atcaagacac ttccgtggca
4381  agacaactaa atgtataaga agtccatgga tgccctgagc aggccacact tgtacagcat
4441  taaaccatgg cagatacaat aggataagcc actttgttac ttactgggc tgggagaaga
4501  ggaatgacgg ggtagaattt tccctcagac gtacttttta tataaatatg tccctggcac
4561  ctaacacgcg ctagtttacc agtgttttct attagacttc cttctatgtt ttctgtttca
4621  ttgttttgag ttgtaaatat gtgttcctgt cttcatttca tgaagtaaac aaacaaacaa
4681  aaaacccagt attaagtatt atcaaagaac aaccatgatt ccacattcga acccattcaa
4741  accatcagta ttgtgaccaa aagcctttaa ctaagaagga gtaaccatgc aaaaatccat
4801  agaggaattt aacccaaaat tttagtctca gcattgtgtc tgctgaggtg tgtatatgag
4861  actacgaaag tgaactactc ttcaaatcca ctttgccttc actcctctat accctaaatc
4921  tagtgtaaac cacacatgga ggataacttt tttttttaat tttaaaagtg tttattagat
4981  atgttttct tcctggtaaa ctgcagccaa acatcagtta agagccattt ttgataaaca
5011  ctatcacaat gatctcggga tccatccttt ccgatttacc aagtgatgga tagacgtgaa
5101  ctcataaaca ctacccataa gacaaaacaa tgagtgccag acaagacatc agccaggcac
5161  cagagcacag agcaggactg gcaatctgt tggagatatc tagaaagttc acaaaggaaa
5221  caagattgtc cactaccttg tgagatctag cagtcataaa taccagggaa atggaaagtg
5281  tgtttcctta cagcaccagg tcttcgatct tcctaatgct gtgacccttt aatacagttt
5341  gccatgttgt ggtgaccccc aaccataaaa ttatttttgt tgctacttca taactgtaaa
5401  tttgctactc ttacagacca caatgtaaat atctgatatg ctatctgata tgcaggctat
5461  ctgacagagg tcgcaacccg caggttgaga gccactgcct tcaaggcttt aatcaagaga
5521  gtagtgagct aggggcttta ctggtcaagtc aggggcaagt ccaactcaat catcctcaca
5581  tactggctgc tccctcaggc ctgagaatga ggcttgcagc atcctctggt ttcctaaccg
5641  ttatccatcc ctgactctca tctctgaaaa tagatgtcat ccatgaaatt aaggagtgag
5701  aatattaagc agcatttata gagctcaaaa ttccatgtca tcaccaggaa gtgccatgtt
5761  gatcacagag aacacagagg agacatatag acaggtttt gctcaaaatt gggatataga
5821  atgagcctgt caggtaccta tcaggagcgg taatccgtga gagagaaccg ttgcaagcca
5881  ctctaactgt agcaatgaaa ccctagtatt tttgtacttt gaaatacttt cttataacaa
5941  aataaagtag caaaaaaact gttcaaaaaa aaaaaaaaaa aaa
```

SEQ ID NO: 110 Mouse EGFR Amino Acid Sequence Isoform A (NP_997538.1)

```
    1  mrpsgtartt llvlltalca aggaleekkv cqgtsnrltq lgtfedhfls lqrmynncev
   61  vlgnleityv qrnydlsflk tiqevagyvl ialntverip lenlqiirgn alyentyala
  121  ilsnygtnrt glrelpmrnl qeiligavrf snnpilcnmd tiqwrdivgn vfmsnmsmdl
  181  qshpsscpkc dpscpngscw gggeencqkl tkiicaqqcs hrcrgrspsd cchnqcaagc
  241  tgpresdclv cqkfqdeatc kdtcpplmly nptttyqmdvn pegkysfgat cvkkcprnyv
  301  vtdhgscvra cgpdyyevee dgirkckkcd gpcrkvcngi gigefkdtls inatnikhfk
  361  yctaisgdlh ilpvafkgds ftrtppldpr eleiltlvhk itgflligaw pdnwtdlhaf
  421  enleiirgrt kqhgqfslav vglnitslgl rslkeisdgd viisgnrnlc yantinwkkl
  481  fgtpnqktki mnnraekdck avnhvcnplc ssegcwgpep rdcvscqnvs rgrecvekcn
  541  ilegepreefv enseciqchp eclpqamnit ctgrgpdnci qcahyidgph cvktcpagim
  601  genntlvwky adannvchlc hanctygcag pglqgcevwp sgpkipsiat givggllfiv
  661  vvalgiglfm rrrhivrkrt lrrllqerel vepltpsgea pnqahlrilk etefkkikvl
  721  gsgafgtvyk glwipegekv kipvaikelr eatspkanke ildeayvmas vdnphvcrll
  781  gicltstvql itqlmpygcl ldyvrehkdn igsqyllnwc vqiakgmnyl edrrlvhrdl
  841  aarnvlvktp qhvkitdfgl akllgaeeke yhaeggkvpi kwmalesilh riythqsdvw
  901  sygvtvwelm tfgskpydgi pasdissile kgerlpqppi ctidvymimv kcwmidadsr
  961  pkfrelilef skmardpqry lviqqdermh lpsptdsnfy ralmdeedme dvvdadeyli
 1021  pqqgffnsps tsrtpllssl satsnnstva cinrngscrv kedaflqrys sdptgavted
 1081  niddaflpvp eyvnqsvpkr pagsvqnpvy hnqplhpapg rdlyqnphs navgnpeyln
 1141  taqptclssg fnspalwiqk gshqmsldnp dyqqdffpke tkpngifkgp taenaeylrv
 1201  appssefiga
```

SEQ ID NO: 111 Mouse EGFR cDNA Sequence Variant 2 (NM_007912.4, CDS: from 281 to 22478)

```
    1  ctcccccagt cccgacccga gctaactaga cgtctgggca gccccagcgc aacgcgcagc
   61  agccccctc ctcttcttcc cgcactgtgc gctcccctg ggctagggcg tctggatcga
  121  gtcccggagg ctaccgcctc ccagacagac gacaggtcac ctggacgcga gcctgtgtcc
  181  gggtctcgtc gttgccggcg cagccactgg gcacaacgt gggactccgt ctgtctcgga
  241  ttaatcccgg agagccgcag ccaacctctc ccggtcagag atgcgacctt cagggaccgc
  301  gagaaccaca ccgctgtgt tgctgaccgc gctctcgcc gcaggtgggg cgttggagga
  361  aaagaaagtc tgccaagca caagtaacag gctcacccaa ctgggcactt tgaagacca
  421  cttctgagc ctgcagagga tgtacaacaa ctgtgaagtg gtccttggga acttggaaat
  481  tacctatgtg caaaggaatt acgaccttc cttccttaaag accatccagg aggtggccgg
```

TABLE 1-continued

```
 541 ctatgtcctc attgccctca acaccgtgga gagaatccct ttggagaacc tgcagatcat
 601 cagggggaaat gctctttatg aaaacaccta tgccttagcc atcctgtcca actatgggac
 661 aaacagaact gggcttaggg aactgcccat gcggaactta caggaaatcc tgattggtgc
 721 tgtgcgattc agcaacaacc ccatcctctg caatatggat actatccagt ggagggacat
 781 cgtccaaaac gtctttatga gcaacatgtc aatggactta cagagccatc cgagcagttg
 841 ccccaaatgt gatccaagct gtcccaatgg aagctgcctgg ggaggaggag aggagaactg
 901 ccagaaattg accaaaatca tctgtgccca gcaatgttcc catcgctgtc gtggcaggtc
 961 ccccagtgac tgctgccaca accaatgtgc tgcggggtgt acagggcccc gagagagtga
1021 ctgtctggtc tgccaaaagt tccaagatga ggccacatgc aaagacacct gcccaccact
1081 catgctgtac aaccccacca cctatcagat ggatgtcaac cctgaaggga agtacagctt
1141 tggtgccacc tgtgtgaaga agtgcccccg aaactacgtg gtgacagatc atggctcatg
1201 tgtccgagcc tgtgggcctg actactacga agtggaagaa gatggcatcc gcaagtgtaa
1261 aaaatgtgat gggccctgtc gcaaagtttg taatggcata ggcattggtg aatttaaaga
1321 cacactctcc ataaatgcta caaacatcaa acacttcaaa tactgcactg ccatcagcgg
1381 ggaccttcac atcctgccag tggcctttaa gggggattct ttcacgcgca ctcctcctct
1441 agacccacga gaactagaaa ttctaaaaac cgtaaaggaa ataacaggct ttttgctgat
1501 tcaggcttgg cctgataact ggactgacct ccatgctttc gagaacctag aaataatacg
1561 tggcagaaca aagcaacatg gtcagttttc tttggcggtc gttggcctga acatcacatc
1621 actggggctg cgttccctca aggagatcag tgatggggat gtgatcattt ctggaaaccg
1681 aaatttgtgc tacgcaaaca caataaactg gaaaaaactc ttcgggacac ccaatcagaa
1741 aaccaaaatc atgaacaaca gagctgagaa agactgcaag gccgtgaacc acgtctgcaa
1801 tccttatgc tcctcggaag gctgctgggg ccctgagccc agggactgtg tctcctgcca
1861 gaatgtgagc agaggcaggg agtgcgtgga gaaatgcaac atcctggagg gggaaccaag
1921 ggagtttgtg gaaaattctg aatgcatcca gtgccatcca gaatgtctgc cccaggccat
1981 gaacatcacc tgtacaggca ggggaccaga caactgcatc cagtgtgccc actacattga
2041 tggcccacac tgtgtcaaga cctgcccagc tggcatcatg ggagagaaca acactctggt
2101 ctggaagtat gcagatgcca ataatgtctg ccacctatgc cacgccaact gtacctatgg
2161 atgtgctggg ccaggtcttc aaggatgtga agtgtggcca tctgggtacg ttcaatggca
2221 gtggatctta aagaccttt ggatctaaga ccagaagcca tctctgactc ccctctcacc
2281 ttccagtttc ttccaaatcc tctgggccag ccagaggtct cagattctgc cctcttgccc
2341 tgtgcccacc ttgttgacca ctggacagca tatgtgatgg ctactgctag tgccagcttc
2401 acaagaggtt aacactacgg actagccatt cttcctatgt atctgtttct gcaaatacag
2461 ccgctttact taagtctcag cacttcttag tctcctcttt tcctctcagt agcccaaggg
2521 gtcatgtcac aaacatggtg tgaagggcta ctttgtcaaa tgaaaaggtc tatcttgggg
2581 ggcattttt tctttctttt ttttcttgaa acacattgcc cagcaaagcc aataaatttc
2641 tctcatcatt ttgtttctga taaattctta ctattgat
```

SEQ ID NO: 112 Mouse EGFR Amino Acid Sequence Isoform B (NP_031938.1)

```
   1 mrpsgtartt llvlltalca aggaleekkv cqgtsnrltq lgtfedhfls lqrmynncev
  61 vlgnleityv qrnydlsflk tiqevagyvl ialntverip lenlqiirgn alyentyala
 121 ilsnygtnrt glrelpmrnl qeiligavrf snnpilcnmd tiqwrdivqn vfmsnmsmdl
 181 qshpsscpkc dpscpngscw gggeencqkl tkiicaqqcs hrccgrspsd cchnqcaagc
 241 tgpresdclv cqkfqdeatc kdtcpplmly npttyqmdvn pegkysfgat cvkkcprnyv
 301 vtdhgscvra cgpdyyevee dgirkckkcd gpcrkvcngi gigefkdtls inatnikhfk
 361 yctaisgdlh ilpvafkgds ftrtppldpr eleilktvke itgflliqaw pdnwtdlhaf
 421 enleiirgrt kqhgqfslav vglnitslgl rslkeisdgd viisgnrnlc yantinwkkl
 481 fgtpnqktki mnnraekdck avnhvcnplc ssegcwgpep rdcvscqnvs rgrecvekcn
 541 ilegeprefv enseciqchp eclpqamnit ctgrgpdnci qcahyidgph cvktcpagim
 601 genntlvwky adannvchlc hanctygcag pglqgcevwp sgyvqwqwil ktfwi
```

* Included in Table 1 are RNA nucleic acid molecules (e.g., thymines replaced with uredines), nucleic acid molecules encoding orthologs of the encoded proteins, as well as DNA or RNA nucleic acid sequences comprising a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5% or more identity across their full length with the nucleic acid sequence of any SEQ ID NO or biomarker described in Table 1 (see below for example), or a portion thereof. Such nucleic acid molecules can have a function of the full-length nucleic acid as described further herein.
* Included in Table 1 are orthologs of the proteins, as well as polypeptide molecules comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with an amino acid sequence of any SEQ ID NO or biomarker described in Table 1 (see below for example), or a portion thereof. Such polypeptides can have a function of the full-length polypeptide as described further herein.
* Included in Table 1 are one or more subunits of a SWI/SNF complex like BAF or PBAF, and mutations within the one more more subunits. In some embodiments, the biomarkers are a class of mutations encompassing the one or more subunits of a SWI/SNF complex, such as the class of synonymous and/or non-synonymous mutations of ARID2 and/or PBRM1, or the class of loss-of-function mutations for biomarkers shown in Tables 4-5. In other embodiment, the biomarkers are particular mutations of one or more subunits of a SWI/SNF complex, such as particular mutations described in the Tables and Examples (e.g., Tables 4-5). Thus, included in Table 1 is, for example, PBRM1, ARID2, BRD7, PHF10, KDM6A, ARID1A, ARID1B, BRG1, BRM, CRB1, and or EGFR, including any cDNA or polypeptide of PBRM1, ARID2, BRD7, PHF10, KDM6A, ARID1A, ARID1B, BRG1, BRM, CRB1, and EGFR. Similarly, included in Table 1 is, for example, PBRM1, ARID2, BRD7, PHF10, KDM6A, ARID1A, ARID1B, BRG1, BRM, CRB1, and EGFR nucleic acid and/or amino acid sequences encoding or representing PBRM1, ARID2, BRD7, PHF10, KDM6A, ARID1A, ARID1B, BRG1, BRM, and EGFR having reduced or eliminated function (e.g, truncating mutations causing encoding of incomplete protein of PBRM1, ARID2, BRD7, PHF10, KDM6A, ARID1A, ARID1B, BRG1, BRM, and EGFR). Many of these mutations were found in subjects having cancer and who were insensitive to immune checkpoint therapies. It is further determined that EGFR as a biomarker of immune checkpoint efficacy acts in opposite fashion to the other biomarkers described in Table 1 such that EGFR is mutated more frequently (e.g., hotspot mutations) in non-responders or less efficacious responders to immune checkpoint therapy rather than more frequently in subjects who respond to immune checkpoint therapy.

II. Subjects

In one embodiment, the subject for whom predicted likelihood of efficacy of an immune checkpoint therapy is determined, is a mammal (e.g., mouse, rat, primate, non-human mammal, domestic animal, such as a dog, cat, cow, horse, and the like), and is preferably a human.

In another embodiment of the methods of the present invention, the subject has not undergone treatment, such as chemotherapy, radiation therapy, targeted therapy, and/or immune checkpoint therapy. In still another embodiment, the subject has undergone treatment, such as chemotherapy, radiation therapy, targeted therapy, and/or immune checkpoint therapy.

In certain embodiments, the subject has had surgery to remove cancerous or precancerous tissue. In other embodiments, the cancerous tissue has not been removed, e.g., the cancerous tissue may be located in an inoperable region of the body, such as in a tissue that is essential for life, or in a region where a surgical procedure would cause considerable risk of harm to the patient.

The methods of the present invention can be used to determine the responsiveness to anti-immune checkpoint therapies of a cancer. In one embodiment, the cancer is one for which an immune checkpoint therapy (e.g., anti-PD-1 blocking antibody, anti-PD-L1 blocking antibody, CTLA-4 blocking antibody, and the like) is FDA-approved for treatment, such as those described in the Examples. In one embodiment, the cancers are solid tumors, such as lung cancer such as non-small cell lung cancer, bladder cancer, melanoma such as metastatic melanoma, and/or renal cell carcinoma. In another embodiment, the cancer is an epithelial cancer such as, but not limited to, brain cancer (e.g., glioblastomas) bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In still other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, brenner, or undifferentiated. In yet other embodiments, the cancer is a mesenchymal cancer, such as sarcoma.

III. Sample Collection, Preparation and Separation

In some embodiments, biomarker amount and/or activity measurement(s) in a sample from a subject is compared to a predetermined control (standard) sample. The sample from the subject is typically from a diseased tissue, such as cancer cells or tissues. The control sample can be from the same subject or from a different subject. The control sample is typically a normal, non-diseased sample. However, in some embodiments, such as for staging of disease or for evaluating the efficacy of treatment, the control sample can be from a diseased tissue. The control sample can be a combination of samples from several different subjects. In some embodiments, the biomarker amount and/or activity measurement(s) from a subject is compared to a pre-determined level. This pre-determined level is typically obtained from normal samples. As described herein, a "pre-determined" biomarker amount and/or activity measurement(s) may be a biomarker amount and/or activity measurement(s) used to, by way of example only, evaluate a subject that may be selected for treatment, evaluate a response to an immune checkpoint therapy, and/or evaluate a response to a combination immune checkpoint therapy. A pre-determined biomarker amount and/or activity measurement(s) may be determined in populations of patients with or without cancer. The pre-determined biomarker amount and/or activity measurement(s) can be a single number, equally applicable to every patient, or the pre-determined biomarker amount and/or activity measurement(s) can vary according to specific subpopulations of patients. Age, weight, height, and other factors of a subject may affect the pre-determined biomarker amount and/or activity measurement(s) of the individual. Furthermore, the pre-determined biomarker amount and/or activity can be determined for each subject individually. In one embodiment, the amounts determined and/or compared in a method described herein are based on absolute measurements.

In another embodiment, the amounts determined and/or compared in a method described herein are based on relative measurements, such as ratios (e.g., biomarker copy numbers, level, and/or activity before a treatment vs. after a treatment, such biomarker measurements relative to a spiked or man-made control, such biomarker measurements relative to the expression of a housekeeping gene, and the like). For example, the relative analysis can be based on the ratio of pre-treatment biomarker measurement as compared to post-treatment biomarker measurement. Pre-treatment biomarker measurement can be made at any time prior to initiation of anti-cancer therapy. Post-treatment biomarker measurement can be made at any time after initiation of anti-cancer therapy. In some embodiments, post-treatment biomarker measurements are made 1, 2, 3, 4, 5, 6, 7, 8, 9, 10, 11, 12, 13, 14, 15, 16, 17, 18, 19, 20 weeks or more after initiation of anti-cancer therapy, and even longer toward indefinitely for continued monitoring. Treatment can comprise anti-cancer therapy, such as a therapeutic regimen comprising an anti-PD1 monoclonal antibody (e.g., nivolumab) alone or in combination with other anti-cancer agents, such as anti-PD-L1/PD-L2 antibodies, anti-VEGF agents (e.g., bevacizumab), agents described in the Examples, Figures, and Tables, or anti-PBRM1 (or anti-ARID2, anti-BRD7, anti-PHF10, or anti-KDM6A) agents.

The pre-determined biomarker amount and/or activity measurement(s) can be any suitable standard. For example, the pre-determined biomarker amount and/or activity measurement(s) can be obtained from the same or a different human for whom a patient selection is being assessed. In one embodiment, the pre-determined biomarker amount and/or activity measurement(s) can be obtained from a previous assessment of the same patient. In such a manner, the progress of the selection of the patient can be monitored over time. In addition, the control can be obtained from an assessment of another human or multiple humans, e.g., selected groups of humans, if the subject is a human. In such a manner, the extent of the selection of the human for whom selection is being assessed can be compared to suitable other humans, e.g., other humans who are in a similar situation to the human of interest, such as those suffering from similar or the same condition(s) and/or of the same ethnic group.

In some embodiments of the present invention the change of biomarker amount and/or activity measurement(s) from the pre-determined level is about 0.1, 0.2, 0.3, 0.4, 0.5, 0.6, 0.7, 0.8, 0.9, 1.0, 1.5, 2.0, 2.5, 3.0, 3.5, 4.0, 4.5, or 5.0 fold or greater, or any range in between, inclusive. Such cutoff values apply equally when the measurement is based on relative changes, such as based on the ratio of pre-treatment biomarker measurement as compared to post-treatment biomarker measurement.

Biological samples can be collected from a variety of sources from a patient including a body fluid sample, cell sample, or a tissue sample comprising nucleic acids and/or proteins. "Body fluids" refer to fluids that are excreted or secreted from the body as well as fluids that are normally not (e.g., amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit). In a preferred embodiment, the subject and/or control sample is selected from the group consisting of cells, cell lines, histological slides, paraffin embedded tissues, biopsies, whole blood, nipple aspirate, serum, plasma, buccal scrape, saliva, cerebrospinal fluid, urine, stool, and bone marrow. In one embodiment, the sample is serum, plasma, or urine. In another embodiment, the sample is serum.

The samples can be collected from individuals repeatedly over a longitudinal period of time (e.g., once or more on the order of days, weeks, months, annually, biannually, etc.). Obtaining numerous samples from an individual over a period of time can be used to verify results from earlier detections and/or to identify an alteration in biological pattern as a result of, for example, disease progression, drug treatment, etc. For example, subject samples can be taken and monitored every month, every two months, or combinations of one, two, or three month intervals according to the present invention. In addition, the biomarker amount and/or activity measurements of the subject obtained over time can be conveniently compared with each other, as well as with those of normal controls during the monitoring period, thereby providing the subject's own values, as an internal, or personal, control for long-term monitoring.

Sample preparation and separation can involve any of the procedures, depending on the type of sample collected and/or analysis of biomarker measurement(s). Such procedures include, by way of example only, concentration, dilution, adjustment of pH, removal of high abundance polypeptides (e.g., albumin, gamma globulin, and transferrin, etc.), addition of preservatives and calibrants, addition of protease inhibitors, addition of denaturants, desalting of samples, concentration of sample proteins, extraction and purification of lipids.

The sample preparation can also isolate molecules that are bound in non-covalent complexes to other protein (e.g., carrier proteins). This process may isolate those molecules bound to a specific carrier protein (e.g., albumin), or use a more general process, such as the release of bound molecules from all carrier proteins via protein denaturation, for example using an acid, followed by removal of the carrier proteins.

Removal of undesired proteins (e.g., high abundance, uninformative, or undetectable proteins) from a sample can be achieved using high affinity reagents, high molecular weight filters, ultracentrifugation and/or electrodialysis. High affinity reagents include antibodies or other reagents (e.g., aptamers) that selectively bind to high abundance proteins. Sample preparation could also include ion exchange chromatography, metal ion affinity chromatography, gel filtration, hydrophobic chromatography, chromatofocusing, adsorption chromatography, isoelectric focusing and related techniques. Molecular weight filters include membranes that separate molecules on the basis of size and molecular weight. Such filters may further employ reverse osmosis, nanofiltration, ultrafiltration and microfiltration.

Ultracentrifugation is a method for removing undesired polypeptides from a sample. Ultracentrifugation is the centrifugation of a sample at about 15,000-60,000 rpm while monitoring with an optical system the sedimentation (or lack thereof) of particles. Electrodialysis is a procedure which uses an electromembrane or semipermable membrane in a process in which ions are transported through semi-permeable membranes from one solution to another under the influence of a potential gradient. Since the membranes used in electrodialysis may have the ability to selectively transport ions having positive or negative charge, reject ions of the opposite charge, or to allow species to migrate through a semipermable membrane based on size and charge, it renders electrodialysis useful for concentration, removal, or separation of electrolytes.

Separation and purification in the present invention may include any procedure known in the art, such as capillary electrophoresis (e.g., in capillary or on-chip) or chromatography (e.g., in capillary, column or on a chip). Electrophoresis is a method which can be used to separate ionic molecules under the influence of an electric field. Electrophoresis can be conducted in a gel, capillary, or in a microchannel on a chip. Examples of gels used for electrophoresis include starch, acrylamide, polyethylene oxides, agarose, or combinations thereof. A gel can be modified by its cross-linking, addition of detergents, or denaturants, immobilization of enzymes or antibodies (affinity electrophoresis) or substrates (zymography) and incorporation of a pH gradient. Examples of capillaries used for electrophoresis include capillaries that interface with an electrospray.

Capillary electrophoresis (CE) is preferred for separating complex hydrophilic molecules and highly charged solutes. CE technology can also be implemented on microfluidic chips. Depending on the types of capillary and buffers used, CE can be further segmented into separation techniques such as capillary zone electrophoresis (CZE), capillary isoelectric focusing (CIEF), capillary isotachophoresis (cITP) and capillary electrochromatography (CEC). An embodiment to couple CE techniques to electrospray ionization involves the use of volatile solutions, for example, aqueous mixtures containing a volatile acid and/or base and an organic such as an alcohol or acetonitrile.

Capillary isotachophoresis (cITP) is a technique in which the analytes move through the capillary at a constant speed but are nevertheless separated by their respective mobilities. Capillary zone electrophoresis (CZE), also known as free-solution CE (FSCE), is based on differences in the electrophoretic mobility of the species, determined by the charge on the molecule, and the frictional resistance the molecule encounters during migration which is often directly proportional to the size of the molecule. Capillary isoelectric focusing (CIEF) allows weakly-ionizable amphoteric molecules, to be separated by electrophoresis in a pH gradient. CEC is a hybrid technique between traditional high performance liquid chromatography (HPLC) and CE.

Separation and purification techniques used in the present invention include any chromatography procedures known in the art. Chromatography can be based on the differential adsorption and elution of certain analytes or partitioning of analytes between mobile and stationary phases. Different examples of chromatography include, but not limited to, liquid chromatography (LC), gas chromatography (GC), high performance liquid chromatography (HPLC), etc.

IV. Biomarker Nucleic Acids and Polypeptides

One aspect of the present invention pertains to the use of isolated nucleic acid molecules that correspond to biomarker nucleic acids that encode a biomarker polypeptide or a portion of such a polypeptide. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

A biomarker nucleic acid molecule of the present invention can be isolated using standard molecular biology techniques and the sequence information in the database records described herein. Using all or a portion of such nucleic acid sequences, nucleic acid molecules of the present invention can be isolated using standard hybridization and cloning techniques (e.g., as described in Sambrook et al., ed., *Molecular Cloning: A Laboratory Manual,* 2nd ed., Cold Spring Harbor Laboratory Press, Cold Spring Harbor, NY, 1989).

A nucleic acid molecule of the present invention can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the present invention can be prepared by standard synthetic techniques, e.g., using an automated DNA synthesizer.

Moreover, a nucleic acid molecule of the present invention can comprise only a portion of a nucleic acid sequence, wherein the full length nucleic acid sequence comprises a marker of the present invention or which encodes a polypeptide corresponding to a marker of the present invention. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a biomarker nucleic acid sequence. Probes based on the sequence of a biomarker nucleic acid molecule can be used to detect transcripts or genomic sequences corresponding to one or more markers of the present invention. The probe comprises a label group attached thereto, e.g., a radioisotope, a fluorescent compound, an enzyme, or an enzyme co-factor.

A biomarker nucleic acid molecules that differ, due to degeneracy of the genetic code, from the nucleotide sequence of nucleic acid molecules encoding a protein which corresponds to the biomarker, and thus encode the same protein, are also contemplated.

In addition, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

The term "allele," which is used interchangeably herein with "allelic variant," refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene or allele. For example, biomarker alleles can differ from each other in a single nucleotide, or several nucleotides, and can include substitutions, deletions, and insertions of nucleotides. An allele of a gene can also be a form of a gene containing one or more mutations.

The term "allelic variant of a polymorphic region of gene" or "allelic variant", used interchangeably herein, refers to an alternative form of a gene having one of several possible nucleotide sequences found in that region of the gene in the population. As used herein, allelic variant is meant to encompass functional allelic variants, non-functional allelic variants, SNPs, mutations and polymorphisms.

The term "single nucleotide polymorphism" (SNP) refers to a polymorphic site occupied by a single nucleotide, which is the site of variation between allelic sequences. The site is usually preceded by and followed by highly conserved sequences of the allele (e.g., sequences that vary in less than 1/100 or 1/1000 members of a population). A SNP usually arises due to substitution of one nucleotide for another at the polymorphic site. SNPs can also arise from a deletion of a nucleotide or an insertion of a nucleotide relative to a reference allele. Typically the polymorphic site is occupied by a base other than the reference base. For example, where the reference allele contains the base "T" (thymidine) at the polymorphic site, the altered allele can contain a "C" (cytidine), "G" (guanine), or "A" (adenine) at the polymorphic site. SNP's may occur in protein-coding nucleic acid sequences, in which case they may give rise to a defective or otherwise variant protein, or genetic disease. Such a SNP may alter the coding sequence of the gene and therefore specify another amino acid (a "missense" SNP) or a SNP may introduce a stop codon (a "nonsense" SNP). When a SNP does not alter the amino acid sequence of a protein, the SNP is called "silent." SNP's may also occur in noncoding regions of the nucleotide sequence. This may result in defective protein expression, e.g., as a result of alternative splicing, or it may have no effect on the function of the protein.

As used herein, the terms "gene" and "recombinant gene" refer to nucleic acid molecules comprising an open reading frame encoding a polypeptide corresponding to a marker of the present invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the present invention.

In another embodiment, a biomarker nucleic acid molecule is at least 7, 15, 20, 25, 30, 40, 60, 80, 100, 150, 200, 250, 300, 350, 400, 450, 550, 650, 700, 800, 900, 1000, 1100, 1200, 1300, 1400, 1500, 1600, 1700, 1800, 1900, 2000, 2200, 2400, 2600, 2800, 3000, 3500, 4000, 4500, or more nucleotides in length and hybridizes under stringent conditions to a nucleic acid molecule corresponding to a marker of the present invention or to a nucleic acid molecule encoding a protein corresponding to a marker of the present invention. As used herein, the term "hybridizes under stringent conditions" is intended to describe conditions for hybridization and washing under which nucleotide sequences at least 60% (65%, 70%, 75%, 80%, preferably 85%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the present invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the present invention pertains to nucleic acid molecules encoding a polypeptide of the present invention that contain changes in amino acid residues that are not essential for activity. Such polypeptides differ in amino acid sequence from the naturally-occurring proteins which correspond to the markers of the present invention, yet retain biological activity. In one embodiment, a biomarker protein has an amino acid sequence that is at least about 40% identical, 50%, 60%, 70%, 75%, 80%, 83%, 85%, 87.5%, 90%, 91%, 92%, 93%, 94%, 95%, 96%, 97%, 98%, 99% or identical to the amino acid sequence of a biomarker protein described herein.

An isolated nucleic acid molecule encoding a variant protein can be created by introducing one or more nucleotide substitutions, additions or deletions into the nucleotide sequence of nucleic acids of the present invention, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

In some embodiments, the present invention further contemplates the use of anti-biomarker antisense nucleic acid molecules, i.e., molecules which are complementary to a sense nucleic acid of the present invention, e.g., complementary to the coding strand of a double-stranded cDNA molecule corresponding to a marker of the present invention or complementary to an mRNA sequence corresponding to a marker of the present invention. Accordingly, an antisense nucleic acid molecule of the present invention can hydrogen bond to (i.e. anneal with) a sense nucleic acid of the present invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the present invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxy acetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been sub-cloned in an antisense orientation (i.e., RNA transcribed from the inserted nucleic acid will be of an antisense orientation to a target nucleic acid of interest, described further in the following subsection).

The antisense nucleic acid molecules of the present invention are typically administered to a subject or generated in situ such that they hybridize with or bind to cellular mRNA and/or genomic DNA encoding a polypeptide corresponding to a selected marker of the present invention to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the present invention includes direct injection at a tissue site or infusion of the antisense nucleic acid into a blood- or bone marrow-associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the present invention can be an α-anomeric nucleic acid molecule. An α-anomeric nucleic acid molecule forms specific double-stranded hybrids with complementary RNA in which, contrary to the usual α-units, the strands run parallel to each other (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The present invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach (1988) *Nature* 334:585-591) can be used to catalytically cleave mRNA transcripts to thereby inhibit translation of the protein encoded by the mRNA. A ribozyme having specificity for a nucleic acid molecule encoding a polypeptide corresponding to a marker of the present invention can be designed based upon the nucleotide sequence of a cDNA corresponding to the marker. For example, a derivative of a Tetrahymena L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the present invention can be used to select a catalytic RNA having a specific ribonuclease activity from a pool of RNA molecules (see, e.g., Bartel and Szostak (1993) *Science* 261:1411-1418).

The present invention also encompasses nucleic acid molecules which form triple helical structures. For example, expression of a biomarker protein can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N. Y. Acad. Sci.* 660:27-36; and Maher (1992) *Bioassays* 14(12):807-15.

In various embodiments, the nucleic acid molecules of the present invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acid molecules (see Hyrup et al. (1996) *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup (1996), supra; Perry-O'Keefe et al. (1996) *Proc. Natl. Acad. Sci. USA* 93:14670-14675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup (1996), supra). The synthesis of PNA-DNA chimeras can be performed as described in Hyrup (1996), supra, and Finn et al. (1996) *Nucleic Acids Res.* 24(17):3357-3363. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al. (1989) *Nucleic Acids Res.* 17:5973-5988). PNA monomers are then coupled in a step-wise manner to produce a chimeric molecule with a 5' PNA segment and a 3' DNA segment (Finn et al. (1996) *Nucleic Acids Res.* 24:3357-3363). Alternatively, chimeric molecules can be synthesized with a 5' DNA segment and a 3' PNA segment (Peterser et al. (1975) *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al. (1988) *Bio Techniques* 6:958-976) or intercalating agents (see, e.g., Zon (1988) *Pharm. Res.* 5:539-549). To this end, the oligonucleotide can be conjugated to another molecule, e.g., a peptide, hybridization triggered cross-linking agent, transport agent, hybridization-triggered cleavage agent, etc.

Another aspect of the present invention pertains to the use of biomarker proteins and biologically active portions thereof. In one embodiment, the native polypeptide corresponding to a marker can be isolated from cells or tissue sources by an appropriate purification scheme using standard protein purification techniques. In another embodiment, polypeptides corresponding to a marker of the present invention are produced by recombinant DNA techniques. Alternative to recombinant expression, a polypeptide corresponding to a marker of the present invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a biomarker polypeptide include polypeptides comprising amino acid sequences sufficiently identical to or derived from a biomarker protein amino acid sequence described herein, but which includes fewer amino acids than the full length protein, and exhibit at least one activity of the corresponding full-length protein. Typically, biologically active portions comprise a domain or motif with at least one activity of the corresponding protein. A biologically active portion of a protein of the present invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the present invention.

Preferred polypeptides have an amino acid sequence of a biomarker protein encoded by a nucleic acid molecule described herein. Other useful proteins are substantially identical (e.g., at least about 40%, preferably 50%, 60%, 70%, 75%, 80%, 83%, 85%, 88%, 90%, 91%, 92%, 93%, 94%, 95%, 96%, 97%, 98%, or 99%) to one of these sequences and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J Mol. Biol.* 215:403-410. BLAST nucleotide searches can be performed with the NBLAST program, score=100, wordlength=12 to obtain nucleotide sequences homologous to a nucleic acid molecules of the present invention. BLAST protein searches can be performed with the XBLAST program, score=50, wordlength=3 to obtain amino acid sequences homologous to a protein molecules of the present invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another preferred, non-limiting example of a mathematical algorithm utilized for the comparison of sequences is the algorithm of Myers and Miller, (1988) *Comput Appl Biosci,* 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The present invention also provides chimeric or fusion proteins corresponding to a biomarker protein. As used herein, a "chimeric protein" or "fusion protein" comprises all or part (preferably a biologically active part) of a polypeptide corresponding to a marker of the present invention operably linked to a heterologous polypeptide (i.e., a polypeptide other than the polypeptide corresponding to the marker). Within the fusion protein, the term "operably linked" is intended to indicate that the polypeptide of the present invention and the heterologous polypeptide are fused in-frame to each other. The heterologous polypeptide can be fused to the amino-terminus or the carboxyl-terminus of the polypeptide of the present invention.

One useful fusion protein is a GST fusion protein in which a polypeptide corresponding to a marker of the present invention is fused to the carboxyl terminus of GST sequences. Such fusion proteins can facilitate the purification of a recombinant polypeptide of the present invention.

In another embodiment, the fusion protein contains a heterologous signal sequence, immunoglobulin fusion protein, toxin, or other useful protein sequence. Chimeric and fusion proteins of the present invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the present invention can be cloned into such an expression vector such that the fusion moiety is linked in-frame to the polypeptide of the present invention.

A signal sequence can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the present invention pertains to the described polypeptides having a signal sequence, as well as to polypeptides from which the signal sequence has been proteolytically cleaved (i.e., the cleavage products). In one embodiment, a nucleic acid sequence encoding a signal sequence can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the biomarker polypeptides described herein. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a biomarker protein which function as either agonists (mimetics) or as antagonists can be identified by screening combinatorial libraries of mutants, e.g., truncation mutants, of the protein of the present invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the polypeptides of the present invention from a degenerate oligonucleotide sequence. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477).

In addition, libraries of fragments of the coding sequence of a polypeptide corresponding to a marker of the present invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the present invention (Arkin and Yourvan (1992) *Proc. Natl. Acad. Sci. USA* 89:7811-7815; Delgrave et al. 91993) *Protein Engineering* 6(3):327-331).

The production and use of biomarker nucleic acid and/or biomarker polypeptide molecules described herein can be facilitated by using standard recombinant techniques. In some embodiments, such techniques use vectors, preferably expression vectors, containing a nucleic acid encoding a biomarker polypeptide or a portion of such a polypeptide. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, namely expression vectors, are capable of directing the expression of genes to which they are operably linked. In general, expression vectors of utility in recombinant DNA techniques are often in the form of plasmids (vectors). However, the present invention is intended to include such other forms of expression vectors, such as viral vectors (e.g., replication defective retroviruses, adenoviruses and adeno-associated viruses), which serve equivalent functions.

The recombinant expression vectors of the present invention comprise a nucleic acid of the present invention in a form suitable for expression of the nucleic acid in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Methods in Enzymology: Gene Expression Technology* vol. 185, Academic Press, San Diego, CA (1991). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the present invention can be introduced into host cells to thereby produce proteins or peptides, including fusion proteins or peptides, encoded by nucleic acids as described herein.

The recombinant expression vectors for use in the present invention can be designed for expression of a polypeptide corresponding to a marker of the present invention in prokaryotic (e.g., *E. coli*) or eukaryotic cells (e.g., insect cells {using baculovirus expression vectors}, yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, MA) and pRIT5 (Pharmacia, Piscataway, NJ) which fuse glutathione S-transferase (GST), maltose E binding protein, or protein A, respectively, to the target recombinant protein.

Examples of suitable inducible non-fusion *E. coli* expression vectors include pTrc (Amann et al. (1988) *Gene* 69:301-315) and pET 11d (Studier et al., p. 60-89, In *Gene Expression Technology: Methods in Enzymology* vol. 185, Academic Press, San Diego, CA, 1991). Target biomarker nucleic acid expression from the pTrc vector relies on host RNA polymerase transcription from a hybrid trp-lac fusion promoter. Target biomarker nucleic acid expression from the pET 11d vector relies on transcription from a T7 gn10-lac fusion promoter mediated by a co-expressed viral RNA polymerase (T7 gn1). This viral polymerase is supplied by host strains BL21 (DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacterium with an impaired capacity to proteolytically cleave the recombinant protein (Gottesman, p. 119-128, In Gene Expression Technology: Methods in Enzymology vol. 185, Academic Press, San Diego, CA, 1990. Another strategy is to alter the nucleic acid sequence of the nucleic acid to be inserted into an expression vector so that the individual codons for each amino acid are those preferentially utilized in *E. coli* (Wada et al., (1992) *Nucleic Acids Res.* 20:2111-2118). Such alteration of nucleic acid sequences of the present invention can be carried out by standard DNA synthesis techniques.

In another embodiment, the expression vector is a yeast expression vector. Examples of vectors for expression in yeast S. cerevisiae include pYepSec1 (Baldari et al. (1987) EMBO J. 6:229-234), pMFa (Kurjan and Herskowitz (1982) Cell 30:933-943), pJRY88 (Schultz et al. (1987) Gene 54:113-123), pYES2 (Invitrogen Corporation, San Diego, CA), and pPicZ (Invitrogen Corp, San Diego, CA).

Alternatively, the expression vector is a baculovirus expression vector. Baculovirus vectors available for expression of proteins in cultured insect cells (e.g., Sf 9 cells) include the pAc series (Smith et al. (1983)Mol. Cell Biol. 3:2156-2165) and the pVL series (Lucklow and Summers (1989) Virology 170:31-39).

In yet another embodiment, a nucleic acid of the present invention is expressed in mammalian cells using a mammalian expression vector. Examples of mammalian expression vectors include pCDM8 (Seed (1987) Nature 329:840) and pMT2PC (Kaufman et al. (1987) EMBO J. 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) Genes Dev. 1:268-277), lymphoid-specific promoters (Calame and Eaton (1988) Adv. Immunol. 43:235-275), in particular promoters of T cell receptors (Winoto and Baltimore (1989) EMBO J. 8:729-733) and immunoglobulins (Banerji et al. (1983) Cell 33:729-740; Queen and Baltimore (1983) Cell 33:741-748), neuron-specific promoters (e.g., the neurofilament promoter; Byrne and Ruddle (1989) Proc. Natl. Acad. Sci. USA 86:5473-5477), pancreas-specific promoters (Edlund et al. (1985) Science 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) Science 249:374-379) and the α-fetoprotein promoter (Camper and Tilghman (1989) Genes Dev. 3:537-546).

The present invention further provides a recombinant expression vector comprising a DNA molecule cloned into the expression vector in an antisense orientation. That is, the DNA molecule is operably linked to a regulatory sequence in a manner which allows for expression (by transcription of the DNA molecule) of an RNA molecule which is antisense to the mRNA encoding a polypeptide of the present invention. Regulatory sequences operably linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue-specific or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using anti-sense genes (see Weintraub et al. (1986) Trends in Genetics, Vol. 1(1)).

Another aspect of the present invention pertains to host cells into which a recombinant expression vector of the present invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic (e.g., E. coli) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

V. Analyzing Biomarker Nucleic Acids and Polypeptides

Biomarker nucleic acids and/or biomarker polypeptides can be analyzed according to the methods described herein and techniques known to the skilled artisan to identify such genetic or expression alterations useful for the present invention including, but not limited to, 1) an alteration in the level of a biomarker transcript or polypeptide, 2) a deletion or addition of one or more nucleotides from a biomarker gene, 4) a substitution of one or more nucleotides of a biomarker gene, 5) aberrant modification of a biomarker gene, such as an expression regulatory region, and the like.

a. Methods for Detection of Copy Number

Methods of evaluating the copy number of a biomarker nucleic acid are well known to those of skill in the art. The presence or absence of chromosomal gain or loss can be evaluated simply by a determination of copy number of the regions or markers identified herein.

In one embodiment, a biological sample is tested for the presence of copy number changes in genomic loci containing the genomic marker. A copy number of at least 3, 4, 5, 6, 7, 8, 9, or 10 is predictive of poorer outcome of anti-immune checkpoint treatment.

Methods of evaluating the copy number of a biomarker locus include, but are not limited to, hybridization-based assays. Hybridization-based assays include, but are not limited to, traditional "direct probe" methods, such as Southern blots, in situ hybridization (e.g., FISH and FISH plus SKY) methods, and "comparative probe" methods, such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In one embodiment, evaluating the biomarker gene copy number in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid. Alternatively, a Northern blot may be utilized for evaluating the copy number of encoding nucleic acid in a sample. In a Northern blot, mRNA is hybridized to a probe specific for the target region. Comparison of the intensity of the hybridization signal from the probe for the target region with control probe signal from analysis of normal RNA (e.g., a non-amplified portion of the same or related cell, tissue, organ, etc.) provides an estimate of the relative copy number of the target nucleic acid. Alternatively, other methods well known in the art to detect RNA can be used, such that higher or lower expression relative to an appropriate control (e.g., a non-amplified portion of the same or related cell tissue, organ, etc.) provides an estimate of the relative copy number of the target nucleic acid.

An alternative means for determining genomic copy number is in situ hybridization (e.g., Angerer (1987)*Meth. Enzymol* 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application. In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained. The probes are typically labeled, e.g., with radioisotopes or fluorescent reporters. In one embodiment, probes are sufficiently long so as to specifically hybridize with the target nucleic acid(s) under stringent conditions. Probes generally range in length from about 200 bases to about 1000 bases. In some applications it is necessary to block the hybridization capacity of repetitive sequences. Thus, in some embodiments, tRNA, human genomic DNA, or Cot-I DNA is used to block non-specific hybridization.

An alternative means for determining genomic copy number is comparative genomic hybridization. In general, genomic DNA is isolated from normal reference cells, as well as from test cells (e.g., tumor cells) and amplified, if necessary. The two nucleic acids are differentially labeled and then hybridized in situ to metaphase chromosomes of a reference cell. The repetitive sequences in both the reference and test DNAs are either removed or their hybridization capacity is reduced by some means, for example by prehybridization with appropriate blocking nucleic acids and/or including such blocking nucleic acid sequences for said repetitive sequences during said hybridization. The bound, labeled DNA sequences are then rendered in a visualizable form, if necessary. Chromosomal regions in the test cells which are at increased or decreased copy number can be identified by detecting regions where the ratio of signal from the two DNAs is altered. For example, those regions that have decreased in copy number in the test cells will show relatively lower signal from the test DNA than the reference compared to other regions of the genome. Regions that have been increased in copy number in the test cells will show relatively higher signal from the test DNA. Where there are chromosomal deletions or multiplications, differences in the ratio of the signals from the two labels will be detected and the ratio will provide a measure of the copy number. In another embodiment of CGH, array CGH (aCGH), the immobilized chromosome element is replaced with a collection of solid support bound target nucleic acids on an array, allowing for a large or complete percentage of the genome to be represented in the collection of solid support bound targets. Target nucleic acids may comprise cDNAs, genomic DNAs, oligonucleotides (e.g., to detect single nucleotide polymorphisms) and the like. Array-based CGH may also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Methods of preparing immobilized chromosomes or arrays and performing comparative genomic hybridization are well known in the art (see, e.g., U.S. Pat. Nos. 6,335,167; 6,197,501; 5,830,645; and 5,665,549 and Albertson (1984) *EMBO J.* 3: 1227-1234; Pinkel (1988) *Proc. Natl. Acad. Sci. USA* 85: 9138-9142; EPO Pub. No. 430,402; *Methods in Molecular Biology*, Vol. 33: In situ Hybridization Protocols, Choo, ed., Humana Press, Totowa, N.J. (1994), etc.). In another embodiment, the hybridization protocol of Pinkel, et al. (1998) *Nature Genetics* 20: 207-211, or of Kallioniemi (1992) *Proc. Natl Acad Sci USA* 89:5321-5325 (1992) is used.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis, et al. (1990) PCR Protocols, *A Guide to Methods and Applications*, Academic Press, Inc. N.Y.). Measurement of DNA copy number at microsatellite loci using quantitative PCR analysis is described in Ginzonger, et al. (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods of the present invention. In fluorogenic quantitative PCR, quantitation is based on amount of fluorescence signals, e.g., TaqMan and SYBR green.

Other suitable amplification methods include, but are not limited to, ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc.

Loss of heterozygosity (LOH) and major copy proportion (MCP) mapping (Wang, Z. C., et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93; Li et al., (2008) *MBC Bioinform.* 9, 204-219) may also be used to identify regions of amplification or deletion.

b. Methods for Detection of Biomarker Nucleic Acid Expression

Biomarker expression may be assessed by any of a wide variety of well known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

In another embodiment, detecting or determining expression levels of a biomarker and functionally similar homologs thereof, including a fragment or genetic alteration thereof (e.g., in regulatory or promoter regions thereof) comprises detecting or determining RNA levels for the marker of interest. In one embodiment, one or more cells from the subject to be tested are obtained and RNA is isolated from the cells. In a preferred embodiment, a sample of breast tissue cells is obtained from the subject.

In one embodiment, RNA is obtained from a single cell. For example, a cell can be isolated from a tissue sample by laser capture microdissection (LCM). Using this technique, a cell can be isolated from a tissue section, including a stained tissue section, thereby assuring that the desired cell is isolated (see, e.g., Bonner et al. (1997) *Science* 278:1481; Emmert-Buck et al. (1996) *Science* 274:998; Fend et al. (1999) *Am. J. Path.* 154:61 and Murakami et al. (2000) *Kidney Int.* 58:1346). For example, Murakami et al., supra, describe isolation of a cell from a previously immunostained tissue section.

It is also possible to obtain cells from a subject and culture the cells in vitro, such as to obtain a larger population of cells from which RNA can be extracted. Methods for establishing cultures of non-transformed cells, i.e., primary cell cultures, are known in the art.

When isolating RNA from tissue samples or cells from individuals, it may be important to prevent any further changes in gene expression after the tissue or cells has been removed from the subject. Changes in expression levels are known to change rapidly following perturbations, e.g., heat shock or activation with lipopolysaccharide (LPS) or other reagents. In addition, the RNA in the tissue and cells may quickly become degraded. Accordingly, in a preferred embodiment, the tissue or cells obtained from a subject is snap frozen as soon as possible.

RNA can be extracted from the tissue sample by a variety of methods, e.g., the guanidium thiocyanate lysis followed by CsCl centrifugation (Chirgwin et al. (1979) *Biochemistry* 18:5294-5299). RNA from single cells can be obtained as described in methods for preparing cDNA libraries from single cells, such as those described in Dulac, C. (1998) *Curr. Top. Dev. Biol.* 36:245 and Jena et al. (1996) *J. Immunol. Methods* 190:199. Care to avoid RNA degradation must be taken, e.g., by inclusion of RNAsin.

The RNA sample can then be enriched in particular species. In one embodiment, poly(A)+RNA is isolated from the RNA sample. In general, such purification takes advantage of the poly-A tails on mRNA. In particular and as noted above, poly-T oligonucleotides may be immobilized within on a solid support to serve as affinity ligands for mRNA. Kits for this purpose are commercially available, e.g., the MessageMaker kit (Life Technologies, Grand Island, NY).

In a preferred embodiment, the RNA population is enriched in marker sequences. Enrichment can be undertaken, e.g., by primer-specific cDNA synthesis, or multiple rounds of linear amplification based on cDNA synthesis and template-directed in vitro transcription (see, e.g., Wang et al. (1989) PNAS 86, 9717; Dulac et al., supra, and Jena et al., supra).

The population of RNA, enriched or not in particular species or sequences, can further be amplified. As defined herein, an "amplification process" is designed to strengthen, increase, or augment a molecule within the RNA. For example, where RNA is mRNA, an amplification process such as RT-PCR can be utilized to amplify the mRNA, such that a signal is detectable or detection is enhanced. Such an amplification process is beneficial particularly when the biological, tissue, or tumor sample is of a small size or volume.

Various amplification and detection methods can be used. For example, it is within the scope of the present invention to reverse transcribe mRNA into cDNA followed by polymerase chain reaction (RT-PCR); or, to use a single enzyme for both steps as described in U.S. Pat. No. 5,322,770, or reverse transcribe mRNA into cDNA followed by symmetric gap ligase chain reaction (RT-AGLCR) as described by R. L. Marshall, et al., *PCR Methods and Applications* 4: 80-84 (1994). Real time PCR may also be used.

Other known amplification methods which can be utilized herein include but are not limited to the so-called "NASBA"

or "3SR" technique described in *PNAS USA* 87: 1874-1878 (1990) and also described in Nature 350 (No. 6313): 91-92 (1991); Q-beta amplification as described in published European Patent Application (EPA) No. 4544610; strand displacement amplification (as described in G. T. Walker et al., *Clin. Chem.* 42: 9-13 (1996) and European Patent Application No. 684315; target mediated amplification, as described by PCT Publication WO9322461; PCR; ligase chain reaction (LCR) (see, e.g., Wu and Wallace, *Genomics* 4, 560 (1989), Landegren et al., *Science* 241, 1077 (1988)); self-sustained sequence replication (SSR) (see, e.g., Guatelli et al., *Proc. Nat. Acad. Sci. USA,* 87, 1874 (1990)); and transcription amplification (see, e.g., Kwoh et al., *Proc. Natl. Acad. Sci. USA* 86, 1173 (1989)).

Many techniques are known in the state of the art for determining absolute and relative levels of gene expression, commonly used techniques suitable for use in the present invention include Northern analysis, RNase protection assays (RPA), microarrays and PCR-based techniques, such as quantitative PCR and differential display PCR. For example, Northern blotting involves running a preparation of RNA on a denaturing agarose gel, and transferring it to a suitable support, such as activated cellulose, nitrocellulose or glass or nylon membranes. Radiolabeled cDNA or RNA is then hybridized to the preparation, washed and analyzed by autoradiography.

In situ hybridization visualization may also be employed, wherein a radioactively labeled antisense RNA probe is hybridized with a thin section of a biopsy sample, washed, cleaved with RNase and exposed to a sensitive emulsion for autoradiography. The samples may be stained with hematoxylin to demonstrate the histological composition of the sample, and dark field imaging with a suitable light filter shows the developed emulsion. Non-radioactive labels such as digoxigenin may also be used.

Alternatively, mRNA expression can be detected on a DNA array, chip or a microarray. Labeled nucleic acids of a test sample obtained from a subject may be hybridized to a solid surface comprising biomarker DNA. Positive hybridization signal is obtained with the sample containing biomarker transcripts. Methods of preparing DNA arrays and their use are well known in the art (see, e.g., U.S. Pat. Nos. 6,618,679; 6,379,897; 6,664,377; 6,451,536; 548,257; U.S. 20030157485 and Schena et al. (1995) *Science* 20, 467-470; Gerhold et al. (1999) *Trends In Biochem. Sci.* 24, 168-173; and Lennon et al. (2000) *Drug Discovery Today* 5, 59-65, which are herein incorporated by reference in their entirety). Serial Analysis of Gene Expression (SAGE) can also be performed (See for example U.S. Patent Application 20030215858).

To monitor mRNA levels, for example, mRNA is extracted from the biological sample to be tested, reverse transcribed, and fluorescently-labeled cDNA probes are generated. The microarrays capable of hybridizing to marker cDNA are then probed with the labeled cDNA probes, the slides scanned and fluorescence intensity measured. This intensity correlates with the hybridization intensity and expression levels.

Types of probes that can be used in the methods described herein include cDNA, riboprobes, synthetic oligonucleotides and genomic probes. The type of probe used will generally be dictated by the particular situation, such as riboprobes for in situ hybridization, and cDNA for Northern blotting, for example. In one embodiment, the probe is directed to nucleotide regions unique to the RNA. The probes may be as short as is required to differentially recognize marker mRNA transcripts, and may be as short as, for example, 15 bases; however, probes of at least 17, 18, 19 or 20 or more bases can be used. In one embodiment, the primers and probes hybridize specifically under stringent conditions to a DNA fragment having the nucleotide sequence corresponding to the marker. As herein used, the term "stringent conditions" means hybridization will occur only if there is at least 95% identity in nucleotide sequences. In another embodiment, hybridization under "stringent conditions" occurs when there is at least 97% identity between the sequences.

The form of labeling of the probes may be any that is appropriate, such as the use of radioisotopes, for example, $^{32}P$ and $^{15}S$. Labeling with radioisotopes may be achieved, whether the probe is synthesized chemically or biologically, by the use of suitably labeled bases.

In one embodiment, the biological sample contains polypeptide molecules from the test subject. Alternatively, the biological sample can contain mRNA molecules from the test subject or genomic DNA molecules from the test subject.

In another embodiment, the methods further involve obtaining a control biological sample from a control subject, contacting the control sample with a compound or agent capable of detecting marker polypeptide, mRNA, genomic DNA, or fragments thereof, such that the presence of the marker polypeptide, mRNA, genomic DNA, or fragments thereof, is detected in the biological sample, and comparing the presence of the marker polypeptide, mRNA, genomic DNA, or fragments thereof, in the control sample with the presence of the marker polypeptide, mRNA, genomic DNA, or fragments thereof in the test sample.

c. Methods for Detection of Biomarker Protein Expression

The activity or level of a biomarker protein can be detected and/or quantified by detecting or quantifying the expressed polypeptide. The polypeptide can be detected and quantified by any of a number of means well known to those of skill in the art. Aberrant levels of polypeptide expression of the polypeptides encoded by a biomarker nucleic acid and functionally similar homologs thereof, including a fragment or genetic alteration thereof (e.g., in regulatory or promoter regions thereof) are associated with the likelihood of response of a cancer to an immune checkpoint therapy. Any method known in the art for detecting polypeptides can be used. Such methods include, but are not limited to, immunodiffusion, immunoelectrophoresis, radioimmunoassay (RIA), enzyme-linked immunosorbent assays (ELISAs), immunofluorescent assays, Western blotting, binder-ligand assays, immunohistochemical techniques, agglutination, complement assays, high performance liquid chromatography (HPLC), thin layer chromatography (TLC), hyperdiffusion chromatography, and the like (e.g., Basic and Clinical Immunology, Sites and Terr, eds., Appleton and Lange, Norwalk, Conn. pp 217-262, 1991 which is incorporated by reference). Preferred are binder-ligand immunoassay methods including reacting antibodies with an epitope or epitopes and competitively displacing a labeled polypeptide or derivative thereof.

For example, ELISA and RIA procedures may be conducted such that a desired biomarker protein standard is labeled (with a radioisotope such as $^{125}I$ or $^{35}S$, or an assayable enzyme, such as horseradish peroxidase or alkaline phosphatase), and, together with the unlabelled sample, brought into contact with the corresponding antibody, whereon a second antibody is used to bind the first, and radioactivity or the immobilized enzyme assayed (competitive assay). Alternatively, the biomarker protein in the sample is allowed to react with the corresponding immobilized antibody, radioisotope- or enzyme-labeled anti-biomarker protein antibody is allowed to react with the system, and radioactivity or the enzyme assayed (ELISA-sandwich assay). Other conventional methods may also be employed as suitable.

The above techniques may be conducted essentially as a "one-step" or "two-step" assay. A "one-step" assay involves contacting antigen with immobilized antibody and, without washing, contacting the mixture with labeled antibody. A "two-step" assay involves washing before contacting, the mixture with labeled antibody. Other conventional methods may also be employed as suitable.

In one embodiment, a method for measuring biomarker protein levels comprises the steps of: contacting a biological specimen with an antibody or variant (e.g., fragment) thereof which selectively binds the biomarker protein, and detecting whether said antibody or variant thereof is bound to said sample and thereby measuring the levels of the biomarker protein.

Enzymatic and radiolabeling of biomarker protein and/or the antibodies may be effected by conventional means. Such means will generally include covalent linking of the enzyme to the antigen or the antibody in question, such as by glutaraldehyde, specifically so as not to adversely affect the activity of the enzyme, by which is meant that the enzyme must still be capable of interacting with its substrate, although it is not necessary for all of the enzyme to be active, provided that enough remains active to permit the assay to be effected. Indeed, some techniques for binding enzyme are non-specific (such as using formaldehyde), and will only yield a proportion of active enzyme.

It is usually desirable to immobilize one component of the assay system on a support, thereby allowing other components of the system to be brought into contact with the component and readily removed without laborious and time-consuming labor. It is possible for a second phase to be immobilized away from the first, but one phase is usually sufficient.

It is possible to immobilize the enzyme itself on a support, but if solid-phase enzyme is required, then this is generally best achieved by binding to antibody and affixing the antibody to a support, models and systems for which are well-known in the art. Simple polyethylene may provide a suitable support.

Enzymes employable for labeling are not particularly limited, but may be selected from the members of the oxidase group, for example. These catalyze production of hydrogen peroxide by reaction with their substrates, and glucose oxidase is often used for its good stability, ease of availability and cheapness, as well as the ready availability of its substrate (glucose). Activity of the oxidase may be assayed by measuring the concentration of hydrogen peroxide formed after reaction of the enzyme-labeled antibody with the substrate under controlled conditions well-known in the art.

Other techniques may be used to detect biomarker protein according to a practitioner's preference based upon the present disclosure. One such technique is Western blotting (Towbin et at., *Proc. Nat. Acad. Sci.* 76:4350 (1979)), wherein a suitably treated sample is run on an SDS-PAGE gel before being transferred to a solid support, such as a nitrocellulose filter. Anti-biomarker protein antibodies (unlabeled) are then brought into contact with the support and assayed by a secondary immunological reagent, such as labeled protein A or anti-immunoglobulin (suitable labels including $^{125}$I, horseradish peroxidase and alkaline phosphatase). Chromatographic detection may also be used.

Immunohistochemistry may be used to detect expression of biomarker protein, e.g., in a biopsy sample. A suitable antibody is brought into contact with, for example, a thin layer of cells, washed, and then contacted with a second, labeled antibody. Labeling may be by fluorescent markers, enzymes, such as peroxidase, avidin, or radiolabelling. The assay is scored visually, using microscopy.

Anti-biomarker protein antibodies, such as intrabodies, may also be used for imaging purposes, for example, to detect the presence of biomarker protein in cells and tissues of a subject. Suitable labels include radioisotopes, iodine ($^{125}$I, $^{121}$I), carbon ($^{14}$C), sulphur ($^{35}$S), tritium ($^{3}$H), indium ($^{112}$In), and technetium ($^{99}$mTc), fluorescent labels, such as fluorescein and rhodamine, and biotin.

For in vivo imaging purposes, antibodies are not detectable, as such, from outside the body, and so must be labeled, or otherwise modified, to permit detection. Markers for this purpose may be any that do not substantially interfere with the antibody binding, but which allow external detection. Suitable markers may include those that may be detected by X-radiography, NMR or MRI. For X-radiographic techniques, suitable markers include any radioisotope that emits detectable radiation but that is not overtly harmful to the subject, such as barium or cesium, for example. Suitable markers for NMR and MRI generally include those with a detectable characteristic spin, such as deuterium, which may be incorporated into the antibody by suitable labeling of nutrients for the relevant hybridoma, for example.

The size of the subject, and the imaging system used, will determine the quantity of imaging moiety needed to produce diagnostic images. In the case of a radioisotope moiety, for a human subject, the quantity of radioactivity injected will normally range from about 5 to 20 millicuries of technetium-99. The labeled antibody or antibody fragment will then preferentially accumulate at the location of cells which contain biomarker protein. The labeled antibody or antibody fragment can then be detected using known techniques.

Antibodies that may be used to detect biomarker protein include any antibody, whether natural or synthetic, full length or a fragment thereof, monoclonal or polyclonal, that binds sufficiently strongly and specifically to the biomarker protein to be detected. An antibody may have a $K_d$ of at most about $10^{-6}$M, $10^{-7}$M, $10^{-8}$M, $10^{-9}$M, $10^{-10}$M, $10^{-11}$M, $10^{-12}$M. The phrase "specifically binds" refers to binding of, for example, an antibody to an epitope or antigen or antigenic determinant in such a manner that binding can be displaced or competed with a second preparation of identical or similar epitope, antigen or antigenic determinant. An antibody may bind preferentially to the biomarker protein relative to other proteins, such as related proteins.

Antibodies are commercially available or may be prepared according to methods known in the art.

Antibodies and derivatives thereof that may be used encompass polyclonal or monoclonal antibodies, chimeric, human, humanized, primatized (CDR-grafted), veneered or single-chain antibodies as well as functional fragments, i.e., biomarker protein binding fragments, of antibodies. For example, antibody fragments capable of binding to a biomarker protein or portions thereof, including, but not limited to, Fv, Fab, Fab' and F(ab') 2 fragments can be used. Such fragments can be produced by enzymatic cleavage or by recombinant techniques. For example, papain or pepsin cleavage can generate Fab or F(ab') 2 fragments, respectively. Other proteases with the requisite substrate specificity can also be used to generate Fab or F(ab') 2 fragments. Antibodies can also be produced in a variety of truncated forms using antibody genes in which one or more stop codons have been introduced upstream of the natural stop site. For example, a chimeric gene encoding a F(ab') 2 heavy chain portion can be designed to include DNA sequences encoding the CH, domain and hinge region of the heavy chain.

Synthetic and engineered antibodies are described in, e.g., Cabilly et al., U.S. Pat. No. 4,816,567 Cabilly et al., European Patent No. 0,125,023 B1; Boss et al., U.S. Pat. No. 4,816,397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Queen et al., European Patent No. 0451216 B1; and Padlan, E. A. et al., EP 0519596 A1. See also, Newman, R. et al., BioTechnology, 10: 1455-1460 (1992), regarding primatized antibody, and Ladner et al., U.S. Pat. No. 4,946,778 and Bird, R. E. et al., Science, 242: 423-426 (1988)) regarding single-chain antibodies. Antibodies produced from a library, e.g., phage display library, may also be used.

In some embodiments, agents that specifically bind to a biomarker protein other than antibodies are used, such as peptides. Peptides that specifically bind to a biomarker protein can be identified by any means known in the art. For example, specific peptide binders of a biomarker protein can be screened for using peptide phage display libraries.

d. Methods for Detection of Biomarker Structural Alterations

The following illustrative methods can be used to identify the presence of a structural alteration in a biomarker nucleic acid and/or biomarker polypeptide molecule in order to, for example, identify PBRM1 (or ARID2, BRD7, PHF10, KDM6A, ARID1A, ARID1B, BRG1, BRM, CRB1, EGFR, and the like) proteins that having mutations such as described herein.

In certain embodiments, detection of the alteration involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) Science 241:1077-1080; and Nakazawa et al. (1994) Proc. Natl. Acad. Sci. USA 91:360-364), the latter of which can be particularly useful for detecting point mutations in a biomarker nucleic acid such as a biomarker gene (see Abravaya et al. (1995) Nucleic Acids Res. 23:675-682). This method can include the steps of collecting a sample of cells from a subject, isolating nucleic acid (e.g., genomic, mRNA or both) from the cells of the sample, contacting the nucleic acid sample with one or more primers which specifically hybridize to a biomarker gene under conditions such that hybridization and amplification of the biomarker gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al. (1990) Proc. Natl. Acad. Sci. USA 87:1874-1878), transcriptional amplification system (Kwoh, D. Y. et al. (1989) Proc. Natl. Acad. Sci. USA 86:1173-1177), Q-Beta Replicase (Lizardi, P. M. et al. (1988) Bio-Technology 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a biomarker nucleic acid from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in biomarker nucleic acid can be identified by hybridizing a sample and control nucleic acids, e.g., DNA or RNA, to high density arrays containing hundreds or thousands of oligonucleotide probes (Cronin, M. T. et al. (1996) Hum. Mutat. 7:244-255; Kozal, M. J. et al. (1996) Nat. Med. 2:753-759). For example, biomarker genetic mutations can be identified in two dimensional arrays containing light-generated DNA probes as described in Cronin et al. (1996) supra. Briefly, a first hybridization array of probes can be used to scan through long stretches of DNA in a sample and control to identify base changes between the sequences by making linear arrays of sequential, overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene. Such biomarker genetic mutations can be identified in a variety of contexts, including, for example, germline and somatic mutations.

In yet another embodiment, any of a variety of sequencing reactions known in the art can be used to directly sequence a biomarker gene and detect mutations by comparing the sequence of the sample biomarker with the corresponding wild-type (control) sequence. Examples of sequencing reactions include those based on techniques developed by Maxam and Gilbert (1977) Proc. Natl. Acad. Sci. USA 74:560 or Sanger (1977) Proc. Natl. Acad Sci. USA 74:5463. It is also contemplated that any of a variety of automated sequencing procedures can be utilized when performing the diagnostic assays (Naeve (1995) Biotechniques 19:448-53), including sequencing by mass spectrometry (see, e.g., PCT International Publication No. WO 94/16101; Cohen et al. (1996) Adv. Chromatogr. 36:127-162; and Griffin et al. (1993) Appl. Biochem. Biotechnol. 38:147-159).

Other methods for detecting mutations in a biomarker gene include methods in which protection from cleavage agents is used to detect mismatched bases in RNA/RNA or RNA/DNA heteroduplexes (Myers et al. (1985) Science 230:1242). In general, the art technique of "mismatch cleavage" starts by providing heteroduplexes formed by hybridizing (labeled) RNA or DNA containing the wild-type biomarker sequence with potentially mutant RNA or DNA obtained from a tissue sample. The double-stranded duplexes are treated with an agent which cleaves single-stranded regions of the duplex such as which will exist due to base pair mismatches between the control and sample strands. For instance, RNA/DNA duplexes can be treated with RNase and DNA/DNA hybrids treated with SI nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl. Acad. Sci. USA* 85:4397 and Saleeba et al. (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in biomarker cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a biomarker sequence, e.g., a wild-type biomarker treated with a DNA mismatch repair enzyme, and the cleavage products, if any, can be detected from electrophoresis protocols or the like (e.g., U.S. Pat. No. 5,459,039.)

In other embodiments, alterations in electrophoretic mobility can be used to identify mutations in biomarker genes. For example, single strand conformation polymorphism (SSCP) may be used to detect differences in electrophoretic mobility between mutant and wild type nucleic acids (Orita et al. (1989) *Proc Natl. Acad. Sci USA* 86:2766; see also Cotton (1993) *Mutat. Res.* 285:125-144 and Hayashi (1992) *Genet. Anal. Tech. Appl.* 9:73-79). Single-stranded DNA fragments of sample and control biomarker nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to ensure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys. Chem.* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163; Saiki et al. (1989) *Proc. Natl. Acad. Sci. USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6:1). It is anticipated that in certain embodiments amplification may also be performed using Taq ligase for amplification (Barany (1991) *Proc. Natl. Acad. Sci USA* 88:189). In such cases, ligation will occur only if there is a perfect match at the 3' end of the 5' sequence making it possible to detect the presence of a known mutation at a specific site by looking for the presence or absence of amplification.

3. Anti-Cancer Therapies

The efficacy of immune checkpoint therapy is predicted according to biomarker amount and/or activity associated with a cancer in a subject according to the methods described herein. In one embodiment, such immune checkpoint therapy or combinations of therapies (e.g., anti-PD-1 antibodies) can be administered once a subject is indicated as being a likely responder to immune checkpoint therapy. In another embodiment, such immune checkpoint therapy can be avoided once a subject is indicated as not being a likely responder to immune checkpoint therapy and an alternative treatment regimen, such as targeted and/or untargeted anti-cancer therapies can be administered. Combination therapies are also contemplated and can comprise, for example, one or more chemotherapeutic agents and radiation, one or more chemotherapeutic agents and immunotherapy, or one or more chemotherapeutic agents, radiation and chemotherapy, each combination of which can be with immune checkpoint therapy.

The term "targeted therapy" refers to administration of agents that selectively interact with a chosen biomolecule to thereby treat cancer. For example, anti-PBRM1 agents (or anti-ARID2 agents, anti-BRD7 agents, anti-PHF10 agents, anti-KDM6A agents, etc.), such as therapeutic monoclonal blocking antibodies, which are well-known in the art and described above, can be used to target tumor microenvironments and cells expressing unwanted PBRM1 (or ARID2, BRD7, PHF10, KDM6A, ARID1A, ARID1B, BRG1, BRM, CRB1, EGFR, and the like). Similarly, nivolumab (Opdivo®) is a human IgG4 anti-PD-1 monoclonal antibody that blocks PD-1 activity (see, for example, Wang et al. (2014) *Cancer Immunol. Res.* 2:846-856; Johnson et al. (2015) *Ther. Adv. Med. Oncol.* 7:97-106; and Sundar et al. (2015) *Ther. Adv. Med. Oncol.* 7:85-96).

Immunotherapy is one form of targeted therapy that may comprise, for example, the use of cancer vaccines and/or sensitized antigen presenting cells. For example, an oncolytic virus is a virus that is able to infect and lyse cancer cells, while leaving normal cells unharmed, making them potentially useful in cancer therapy. Replication of oncolytic viruses both facilitates tumor cell destruction and also produces dose amplification at the tumor site. They may also act as vectors for anticancer genes, allowing them to be specifically delivered to the tumor site. The immunotherapy can involve passive immunity for short-term protection of a host, achieved by the administration of pre-formed antibody directed against a cancer antigen or disease antigen (e.g., administration of a monoclonal antibody, optionally linked to a chemotherapeutic agent or toxin, to a tumor antigen). Immunotherapy can also focus on using the cytotoxic lymphocyte-recognized epitopes of cancer cell lines. Alternatively, antisense polynucleotides, ribozymes, RNA interference molecules, triple helix polynucleotides and the like, can be used to selectively modulate biomolecules that are linked to the initiation, progression, and/or pathology of a tumor or cancer.

The term "untargeted therapy" refers to administration of agents that do not selectively interact with a chosen biomolecule yet treat cancer. ReRepresentative examples of untargeted therapies include, without limitation, chemotherapy, gene therapy, and radiation therapy.

In one embodiment, chemotherapy is used. Chemotherapy includes the administration of a chemotherapeutic agent. Such a chemotherapeutic agent may be, but is not limited to, those selected from among the following groups of compounds: platinum compounds, cytotoxic antibiotics, antimetabolities, anti-mitotic agents, alkylating agents, arsenic compounds, DNA topoisomerase inhibitors, taxanes, nucleoside analogues, plant alkaloids, and toxins; and synthetic derivatives thereof. Exemplary compounds include, but are not limited to, alkylating agents: cisplatin, treosulfan, and trofosfamide; plant alkaloids: vinblastine, paclitaxel, docetaxol; DNA topoisomerase inhibitors: teniposide, crisnatol, and mitomycin; anti-folates: methotrexate, mycophenolic acid, and hydroxyurea; pyrimidine analogs: 5-fluorouracil, doxifluridine, and cytosine arabinoside; purine analogs: mercaptopurine and thioguanine; DNA antimetabolites: 2'-deoxy-5-fluorouridine, aphidicolin glycinate, and pyrazoloimidazole; and antimitotic agents: halichondrin, colchicine, and rhizoxin. Compositions comprising one or more chemotherapeutic agents (e.g., FLAG, CHOP) may also be used. FLAG comprises fludarabine, cytosine arabinoside (Ara-C) and G-CSF. CHOP comprises cyclophosphamide, vincristine, doxorubicin, and prednisone. In another embodiments, PARP (e.g., PARP-1 and/or PARP-2) inhibitors are used and such inhibitors are well known in the art (e.g., Olaparib, ABT-888, BSI-201, BGP-15 (N-Gene Research Laboratories, Inc.); INO-1001 (Inotek Pharmaceuticals Inc.); PJ34 (Soriano et al., 2001; Pacher et al., 2002b); 3-aminobenzamide (Trevigen); 4-amino-1,8-naphthalimide; (Trevigen); 6(5H)-phenanthridinone (Trevigen); benzamide (U.S. Pat. Re. 36,397); and NU1025 (Bowman et al.). The mechanism of action is generally related to the ability of PARP inhibitors to bind PARP and decrease its activity. PARP catalyzes the conversion of .beta.-nicotinamide adenine dinucleotide (NAD+) into nicotinamide and poly-ADP-ribose (PAR). Both poly (ADP-ribose) and PARP have been linked to regulation of transcription, cell proliferation, genomic stability, and carcinogenesis (Bouchard V. J. et. al. Experimental Hematology, Volume 31, Number 6, June 2003, pp. 446-454(9); Herceg Z.; Wang Z.-Q. Mutation Research/Fundamental and Molecular Mechanisms of Mutagenesis, Volume 477, Number 1, 2 Jun. 2001, pp. 97-110(14)). Poly(ADP-ribose) polymerase 1 (PARP1) is a key molecule in the repair of DNA single-strand breaks (SSBs) (de Murcia J. et al. 1997. Proc Natl Acad Sci USA 94:7303-7307; Schreiber V, Dantzer F, Ame J C, de Murcia G (2006) Nat Rev Mol Cell Biol 7:517-528; Wang Z Q, et al. (1997) Genes Dev 11:2347-2358). Knockout of SSB repair by inhibition of PARP1 function induces DNA double-strand breaks (DSBs) that can trigger synthetic lethality in cancer cells with defective homology-directed DSB repair (Bryant H E, et al. (2005) Nature 434:913-917; Farmer H, et al. (2005) Nature 434:917-921). The foregoing examples of chemotherapeutic agents are illustrative, and are not intended to be limiting.

In another embodiment, radiation therapy is used. The radiation used in radiation therapy can be ionizing radiation. Radiation therapy can also be gamma rays, X-rays, or proton beams. Examples of radiation therapy include, but are not limited to, external-beam radiation therapy, interstitial implantation of radioisotopes (1-125, palladium, iridium), radioisotopes such as strontium-89, thoracic radiation therapy, intraperitoneal P-32 radiation therapy, and/or total abdominal and pelvic radiation therapy. For a general overview of radiation therapy, see Hellman, Chapter 16: Principles of Cancer Management: Radiation Therapy, 6th edition, 2001, DeVita et al., eds., J. B. Lippencott Company, Philadelphia. The radiation therapy can be administered as external beam radiation or teletherapy wherein the radiation is directed from a remote source. The radiation treatment can also be administered as internal therapy or brachytherapy wherein a radioactive source is placed inside the body close to cancer cells or a tumor mass. Also encompassed is the use of photodynamic therapy comprising the administration of photosensitizers, such as hematoporphyrin and its derivatives, Vertoporfin (BPD-MA), phthalocyanine, photosensitizer Pc4, demethoxy-hypocrellin A; and 2BA-2-DMHA.

In another embodiment, hormone therapy is used. Hormonal therapeutic treatments can comprise, for example, hormonal agonists, hormonal antagonists (e.g., flutamide, bicalutamide, tamoxifen, raloxifene, leuprolide acetate (LUPRON), LH-RH antagonists), inhibitors of hormone biosynthesis and processing, and steroids (e.g., dexamethasone, retinoids, deltoids, betamethasone, cortisol, cortisone, prednisone, dehydrotestosterone, glucocorticoids, mineralocorticoids, estrogen, testosterone, progestins), vitamin A derivatives (e.g., all-trans retinoic acid (ATRA)); vitamin D3 analogs; antigestagens (e.g., mifepristone, onapristone), or antiandrogens (e.g., cyproterone acetate).

In another embodiment, hyperthermia, a procedure in which body tissue is exposed to high temperatures (up to 106° F.) is used. Heat may help shrink tumors by damaging cells or depriving them of substances they need to live. Hyperthermia therapy can be local, regional, and whole-body hyperthermia, using external and internal heating devices. Hyperthermia is almost always used with other forms of therapy (e.g., radiation therapy, chemotherapy, and biological therapy) to try to increase their effectiveness. Local hyperthermia refers to heat that is applied to a very small area, such as a tumor. The area may be heated externally with high-frequency waves aimed at a tumor from a device outside the body. To achieve internal heating, one of several types of sterile probes may be used, including thin, heated wires or hollow tubes filled with warm water; implanted microwave antennae; and radiofrequency electrodes. In regional hyperthermia, an organ or a limb is heated. Magnets and devices that produce high energy are placed over the region to be heated. In another approach, called perfusion, some of the patient's blood is removed, heated, and then pumped (perfused) into the region that is to be heated internally. Whole-body heating is used to treat metastatic cancer that has spread throughout the body. It can be accomplished using warm-water blankets, hot wax, inductive coils (like those in electric blankets), or thermal chambers (similar to large incubators). Hyperthermia does not cause any marked increase in radiation side effects or complications. Heat applied directly to the skin, however, can cause discomfort or even significant local pain in about half the patients treated. It can also cause blisters, which generally heal rapidly.

In still another embodiment, photodynamic therapy (also called PDT, photoradiation therapy, phototherapy, or photochemotherapy) is used for the treatment of some types of cancer. It is based on the discovery that certain chemicals known as photosensitizing agents can kill one-celled organisms when the organisms are exposed to a particular type of light. PDT destroys cancer cells through the use of a fixed-frequency laser light in combination with a photosensitizing agent. In PDT, the photosensitizing agent is injected into the bloodstream and absorbed by cells all over the body. The agent remains in cancer cells for a longer time than it does in normal cells. When the treated cancer cells are exposed to laser light, the photosensitizing agent absorbs the light and produces an active form of oxygen that destroys the treated cancer cells. Light exposure must be timed carefully so that it occurs when most of the photosensitizing agent has left healthy cells but is still present in the cancer cells. The laser light used in PDT can be directed through a fiber-optic (a very thin glass strand). The fiber-optic is placed close to the cancer to deliver the proper amount of light. The fiber-optic can be directed through a bronchoscope into the lungs for the treatment of lung cancer or through an endoscope into the esophagus for the treatment of esophageal cancer. An advantage of PDT is that it causes minimal damage to healthy tissue. However, because the laser light currently in use cannot pass through more than about 3 centimeters of tissue (a little more than one and an eighth inch), PDT is mainly used to treat tumors on or just under the skin or on the lining of internal organs. Photodynamic therapy makes the skin and eyes sensitive to light for 6 weeks or more after treatment. Patients are advised to avoid direct sunlight and bright indoor light for at least 6 weeks. If patients must go outdoors, they need to wear protective clothing, including sunglasses. Other temporary side effects of PDT are related to the treatment of specific areas and can include coughing, trouble swallowing, abdominal pain, and painful breathing or shortness of breath. In December 1995, the U.S. Food and Drug Administration (FDA) approved a photosensitizing agent called porfimer sodium, or Photofrin®, to relieve symptoms of esophageal cancer that is causing an obstruction and for esophageal cancer that cannot be satisfactorily treated with lasers alone. In January 1998, the FDA approved porfimer sodium for the treatment of early nonsmall cell lung cancer in patients for whom the usual treatments for lung cancer are not appropriate. The National Cancer Institute and other institutions are supporting clinical trials (research studies) to evaluate the use of photodynamic therapy for several types of cancer, including cancers of the bladder, brain, larynx, and oral cavity.

In yet another embodiment, laser therapy is used to harness high-intensity light to destroy cancer cells. This technique is often used to relieve symptoms of cancer such as bleeding or obstruction, especially when the cancer cannot be cured by other treatments. It may also be used to treat cancer by shrinking or destroying tumors. The term "laser" stands for light amplification by stimulated emission of radiation. Ordinary light, such as that from a light bulb, has many wavelengths and spreads in all directions. Laser light, on the other hand, has a specific wavelength and is focused in a narrow beam. This type of high-intensity light contains a lot of energy. Lasers are very powerful and may be used to cut through steel or to shape diamonds. Lasers also can be used for very precise surgical work, such as repairing a damaged retina in the eye or cutting through tissue (in place of a scalpel). Although there are several different kinds of lasers, only three kinds have gained wide use in medicine: Carbon dioxide ($CO_2$) laser—This type of laser can remove thin layers from the skin's surface without penetrating the deeper layers. This technique is particularly useful in treating tumors that have not spread deep into the skin and certain precancerous conditions. As an alternative to traditional scalpel surgery, the $CO_2$ laser is also able to cut the skin. The laser is used in this way to remove skin cancers. Neodymium:yttrium-aluminum-garnet (Nd:YAG) laser—Light from this laser can penetrate deeper into tissue than light from the other types of lasers, and it can cause blood to clot quickly. It can be carried through optical fibers to less accessible parts of the body. This type of laser is sometimes used to treat throat cancers. Argon laser—This laser can pass through only superficial layers of tissue and is therefore useful in dermatology and in eye surgery. It also is used with light-sensitive dyes to treat tumors in a procedure known as photodynamic therapy (PDT). Lasers have several advantages over standard surgical tools, including: Lasers are more precise than scalpels. Tissue near an incision is protected, since there is little contact with surrounding skin or other tissue. The heat produced by lasers sterilizes the surgery site, thus reducing the risk of infection. Less operating time may be needed because the precision of the laser allows for a smaller incision. Healing time is often shortened; since laser heat seals blood vessels, there is less bleeding, swelling, or scarring. Laser surgery may be less complicated. For example, with fiber optics, laser light can be directed to parts of the body without making a large incision. More procedures may be done on an outpatient basis. Lasers can be used in two ways to treat cancer: by shrinking or destroying a tumor with heat, or by activating a chemical—known as a photosensitizing agent—that destroys cancer cells. In PDT, a photosensitizing agent is retained in cancer cells and can be stimulated by light to cause a reaction that kills cancer cells. $CO_2$ and Nd:YAG lasers are used to shrink or destroy tumors. They may be used with endoscopes, tubes that allow physicians to see into certain areas of the body, such as the bladder. The light from some lasers can be transmitted through a flexible endoscope fitted with fiber optics. This allows physicians to see and work in parts of the body that could not otherwise be reached except by surgery and therefore allows very precise aiming of the laser beam. Lasers also may be used with low-power microscopes, giving the doctor a clear view of the site being treated. Used with other instruments, laser systems can produce a cutting area as small as 200 microns in diameter—less than the width of a very fine thread. Lasers are used to treat many types of cancer. Laser surgery is a standard treatment for certain stages of glottis (vocal cord), cervical, skin, lung, vaginal, vulvar, and penile cancers. In addition to its use to destroy the cancer, laser surgery is also used to help relieve symptoms caused by cancer (palliative care). For example, lasers may be used to shrink or destroy a tumor that is blocking a patient's trachea (windpipe), making it easier to breathe. It is also sometimes used for palliation in colorectal and anal cancer. Laser-induced interstitial thermotherapy (LITT) is one of the most recent developments in laser therapy. LITT uses the same idea as a cancer treatment called hyperthermia; that heat may help shrink tumors by damaging cells or depriving them of substances they need to live. In this treatment, lasers are directed to interstitial areas (areas between organs) in the body. The laser light then raises the temperature of the tumor, which damages or destroys cancer cells.

The duration and/or dose of treatment with anti-immune checkpoint therapies may vary according to the particular anti-immune checkpoint agent or combination thereof. An appropriate treatment time for a particular cancer therapeutic agent will be appreciated by the skilled artisan. The present invention contemplates the continued assessment of optimal treatment schedules for each cancer therapeutic agent, where the phenotype of the cancer of the subject as determined by the methods of the present invention is a factor in determining optimal treatment doses and schedules.

Any means for the introduction of a polynucleotide into mammals, human or non-human, or cells thereof may be adapted to the practice of this invention for the delivery of the various constructs of the present invention into the intended recipient. In one embodiment of the present invention, the DNA constructs are delivered to cells by transfection, i.e., by delivery of "naked" DNA or in a complex with a colloidal dispersion system. A colloidal system includes macromolecule complexes, nanocapsules, microspheres, beads, and lipid-based systems including oil-in-water emulsions, micelles, mixed micelles, and liposomes. The preferred colloidal system of this invention is a lipid-complexed or liposome-formulated DNA. In the former approach, prior to formulation of DNA, e.g., with lipid, a plasmid containing a transgene bearing the desired DNA constructs may first be experimentally optimized for expression (e.g., inclusion of an intron in the 5' untranslated region and elimination of unnecessary sequences (Felgner, et al., Ann NY Acad Sci 126-139, 1995). Formulation of DNA, e.g. with various lipid or liposome materials, may then be effected using known methods and materials and delivered to the recipient mammal. See, e.g., Canonico et al, Am J Respir Cell Mol Biol 10:24-29, 1994; Tsan et al, Am J Physiol 268; Alton et al., Nat Genet. 5:135-142, 1993 and U.S. Pat. No. 5,679,647 by Carson et al.

The targeting of liposomes can be classified based on anatomical and mechanistic factors. Anatomical classification is based on the level of selectivity, for example, organ-specific, cell-specific, and organelle-specific. Mechanistic targeting can be distinguished based upon whether it is passive or active. Passive targeting utilizes the natural tendency of liposomes to distribute to cells of the reticuloendothelial system (RES) in organs, which contain sinusoidal capillaries. Active targeting, on the other hand, involves alteration of the liposome by coupling the liposome to a specific ligand such as a monoclonal antibody, sugar, glycolipid, or protein, or by changing the composition or size of the liposome in order to achieve targeting to organs and cell types other than the naturally occurring sites of localization.

The surface of the targeted delivery system may be modified in a variety of ways. In the case of a liposomal targeted delivery system, lipid groups can be incorporated into the lipid bilayer of the liposome in order to maintain the targeting ligand in stable association with the liposomal bilayer. Various linking groups can be used for joining the lipid chains to the targeting ligand. Naked DNA or DNA associated with a delivery vehicle, e.g., liposomes, can be administered to several sites in a subject (see below).

Nucleic acids can be delivered in any desired vector. These include viral or non-viral vectors, including adenovirus vectors, adeno-associated virus vectors, retrovirus vectors, lentivirus vectors, and plasmid vectors. Exemplary types of viruses include HSV (herpes simplex virus), AAV (adeno associated virus), HIV (human immunodeficiency virus), BIV (bovine immunodeficiency virus), and MLV (murine leukemia virus). Nucleic acids can be administered in any desired format that provides sufficiently efficient delivery levels, including in virus particles, in liposomes, in nanoparticles, and complexed to polymers.

The nucleic acids encoding a protein or nucleic acid of interest may be in a plasmid or viral vector, or other vector as is known in the art. Such vectors are well known and any can be selected for a particular application. In one embodiment of the present invention, the gene delivery vehicle comprises a promoter and a demethylase coding sequence. Preferred promoters are tissue-specific promoters and promoters which are activated by cellular proliferation, such as the thymidine kinase and thymidylate synthase promoters. Other preferred promoters include promoters which are activatable by infection with a virus, such as the $\alpha$- and $\beta$-interferon promoters, and promoters which are activatable by a hormone, such as estrogen. Other promoters which can be used include the Moloney virus LTR, the CMV promoter, and the mouse albumin promoter. A promoter may be constitutive or inducible.

In another embodiment, naked polynucleotide molecules are used as gene delivery vehicles, as described in WO 90/11092 and U.S. Pat. No. 5,580,859. Such gene delivery vehicles can be either growth factor DNA or RNA and, in certain embodiments, are linked to killed adenovirus. Curiel et al., Hum. Gene. Ther. 3:147-154, 1992. Other vehicles which can optionally be used include DNA-ligand (Wu et al., J. Biol. Chem. 264:16985-16987, 1989), lipid-DNA combinations (Felgner et al., Proc. Natl. Acad. Sci. USA 84:7413 7417, 1989), liposomes (Wang et al., Proc. Natl. Acad. Sci. 84:7851-7855, 1987) and microprojectiles (Williams et al., Proc. Natl. Acad. Sci. 88:2726-2730, 1991).

A gene delivery vehicle can optionally comprise viral sequences such as a viral origin of replication or packaging signal. These viral sequences can be selected from viruses such as astrovirus, coronavirus, orthomyxovirus, papovavirus, paramyxovirus, parvovirus, picornavirus, poxvirus, retrovirus, togavirus or adenovirus. In a preferred embodiment, the growth factor gene delivery vehicle is a recombinant retroviral vector. Recombinant retroviruses and various uses thereof have been described in numerous references including, for example, Mann et al., Cell 33:153, 1983, Cane and Mulligan, Proc. Nat'l. Acad. Sci. USA 81:6349, 1984, Miller et al., Human Gene Therapy 1:5-14, 1990, U.S. Pat. Nos. 4,405,712, 4,861,719, and 4,980,289, and PCT Application Nos. WO 89/02,468, WO 89/05,349, and WO 90/02,806. Numerous retroviral gene delivery vehicles can be utilized in the present invention, including for example those described in EP 0,415,731; WO 90/07936; WO 94/03622; WO 93/25698; WO 93/25234; U.S. Pat. No. 5,219,740; WO 9311230; WO 9310218; Vile and Hart, Cancer Res. 53:3860-3864, 1993; Vile and Hart, Cancer Res. 53:962-967, 1993; Ram et al., Cancer Res. 53:83-88, 1993; Takamiya et al., J. Neurosci. Res. 33:493-503, 1992; Baba et al., J. Neurosurg. 79:729-735, 1993 (U.S. Pat. No. 4,777,127, GB 2,200,651, EP 0,345,242 and WO91/02805).

Other viral vector systems that can be used to deliver a polynucleotide of the present invention have been derived from herpes virus, e.g., Herpes Simplex Virus (U.S. Pat. No. 5,631,236 by Woo et al., issued May 20, 1997 and WO 00/08191 by Neurovex), vaccinia virus (Ridgeway (1988) Ridgeway, "Mammalian expression vectors," In: Rodriguez R L, Denhardt D T, ed. Vectors: A survey of molecular cloning vectors and their uses. Stoneham: Butterworth; Baichwal and Sugden (1986) "Vectors for gene transfer derived from animal DNA viruses: Transient and stable expression of transferred genes," In: Kucherlapati R, ed. Gene transfer. New York: Plenum Press; Coupar et al. (1988) Gene, 68:1-10), and several RNA viruses. Preferred viruses include an alphavirus, a poxivirus, an arena virus, a vaccinia virus, a polio virus, and the like. They offer several attractive features for various mammalian cells (Friedmann (1989) Science, 244:1275-1281; Ridgeway, 1988, supra; Baichwal and Sugden, 1986, supra; Coupar et al., 1988; Horwich et al. (1990) J. Virol., 64:642-650).

In other embodiments, target DNA in the genome can be manipulated using well-known methods in the art. For example, the target DNA in the genome can be manipulated by deletion, insertion, and/or mutation are retroviral insertion, artificial chromosome techniques, gene insertion, random insertion with tissue specific promoters, gene targeting, transposable elements and/or any other method for introducing foreign DNA or producing modified DNA/modified nuclear DNA. Other modification techniques include deleting DNA sequences from a genome and/or altering nuclear DNA sequences. Nuclear DNA sequences, for example, may be altered by site-directed mutagenesis.

In other embodiments, recombinant biomarker polypeptides, and fragments thereof, can be administered to subjects. In some embodiments, fusion proteins can be constructed and administered which have enhanced biological properties. In addition, the biomarker polypeptides, and fragment thereof, can be modified according to well-known pharmacological methods in the art (e.g., pegylation, glycosylation, oligomerization, etc.) in order to further enhance desirable biological activities, such as increased bioavailability and decreased proteolytic degradation.

4. Clinical Efficacy

Clinical efficacy can be measured by any method known in the art. For example, the response to a therapy, such as anti-immune checkpoint therapies, relates to any response of the cancer, e.g., a tumor, to the therapy, preferably to a change in tumor mass and/or volume after initiation of neoadjuvant or adjuvant chemotherapy. Tumor response may be assessed in a neoadjuvant or adjuvant situation where the size of a tumor after systemic intervention can be compared to the initial size and dimensions as measured by CT, PET, mammogram, ultrasound or palpation and the cellularity of a tumor can be estimated histologically and compared to the cellularity of a tumor biopsy taken before initiation of treatment. Response may also be assessed by caliper measurement or pathological examination of the tumor after biopsy or surgical resection. Response may be recorded in a quantitative fashion like percentage change in tumor volume or cellularity or using a semi-quantitative scoring system such as residual cancer burden (Symmans et al., *J. Clin. Oncol.* (2007) 25:4414-4422) or Miller-Payne score (Ogston et al., (2003) *Breast* (Edinburgh, Scotland) 12:320-327) in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of tumor response may be performed early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed.

In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular anti-immune checkpoint therapeutic regimen is at least 25%, 30%, 35%, 40%, 45%, 50%, 55%, 60%, 65%, 70%, 75%, 80%, 85%, or more.

Additional criteria for evaluating the response to anti-immune checkpoint therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence.

For example, in order to determine appropriate threshold values, a particular anti-immune checkpoint therapeutic regimen can be administered to a population of subjects and the outcome can be correlated to biomarker measurements that were determined prior to administration of any immune checkpoint therapy. The outcome measurement may be pathologic response to therapy given in the neoadjuvant setting. Alternatively, outcome measures, such as overall survival and disease-free survival can be monitored over a period of time for subjects following immune checkpoint therapy for whom biomarker measurement values are known. In certain embodiments, the same doses of anti-immune checkpoint agents are administered to each subject. In related embodiments, the doses administered are standard doses known in the art for anti-immune checkpoint agents. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of an immune checkpoint therapy can be determined using methods such as those described in the Examples section.

5. Further Uses and Methods of the Present Invention

The methods described herein can be used in a variety of diagnostic, prognostic, and therapeutic applications. In any method described herein, such as a diagnostic method, prognostic method, therapeutic method, or combination thereof, all steps of the method can be performed by a single actor or, alternatively, by more than one actor. For example, diagnosis can be performed directly by the actor providing therapeutic treatment. Alternatively, a person providing a therapeutic agent can request that a diagnostic assay be performed. The diagnostician and/or the therapeutic interventionist can interpret the diagnostic assay results to determine a therapeutic strategy. Similarly, such alternative processes can apply to other assays, such as prognostic assays. The compositions described herein can also be used in a variety of diagnostic, prognostic, and therapeutic applications regarding biomarkers described herein, such as those listed in Table 1. Moreover, any method of diagnosis, prognosis, prevention, and the like described herein can be applied to a therapy or test agent of interest, such as immune checkpoint therapies, EGFR therapies, anti-cancer therapies, and the like.

a. Screening Methods

One aspect of the present invention relates to screening assays, including non-cell based assays. In one embodiment, the assays provide a method for identifying whether a cancer is likely to respond to immune checkpoint therapy and/or whether an agent can inhibit the growth of or kill a cancer cell that is unlikely to respond to immune checkpoint therapy.

In one embodiment, the present invention relates to assays for screening test agents which bind to, or modulate the biological activity of, at least one biomarker listed in Table 1. In one embodiment, a method for identifying such an agent entails determining the ability of the agent to modulate, e.g. inhibit, the at least one biomarker listed in Table 1.

In one embodiment, an assay is a cell-free or cell-based assay, comprising contacting at least one biomarker listed in Table 1, with a test agent, and determining the ability of the test agent to modulate (e.g. inhibit) the enzymatic activity of the biomarker, such as by measuring direct binding of substrates or by measuring indirect parameters as described below.

For example, in a direct binding assay, biomarker protein (or their respective target polypeptides or molecules) can be coupled with a radioisotope or enzymatic label such that binding can be determined by detecting the labeled protein or molecule in a complex. For example, the targets can be labeled with $^{125}I$, $^{35}S$, $^{14}C$, or $^{3}H$, either directly or indirectly, and the radioisotope detected by direct counting of radioemmission or by scintillation counting. Alternatively, the targets can be enzymatically labeled with, for example, horseradish peroxidase, alkaline phosphatase, or luciferase, and the enzymatic label detected by determination of conversion of an appropriate substrate to product. Determining the interaction between biomarker and substrate can also be accomplished using standard binding or enzymatic analysis assays. In one or more embodiments of the above described assay methods, it may be desirable to immobilize polypeptides or molecules to facilitate separation of complexed from uncomplexed forms of one or both of the proteins or molecules, as well as to accommodate automation of the assay.

Binding of a test agent to a target can be accomplished in any vessel suitable for containing the reactants. Non-limiting examples of such vessels include microtiter plates, test tubes, and micro-centrifuge tubes. Immobilized forms of the antibodies of the present invention can also include antibodies bound to a solid phase like a porous, microporous (with an average pore diameter less than about one micron) or macroporous (with an average pore diameter of more than about 10 microns) material, such as a membrane, cellulose, nitrocellulose, or glass fibers; a bead, such as that made of agarose or polyacrylamide or latex; or a surface of a dish, plate, or well, such as one made of polystyrene.

In an alternative embodiment, determining the ability of the agent to modulate the interaction between the biomarker and a substrate or a biomarker and its natural binding partner can be accomplished by determining the ability of the test agent to modulate the activity of a polypeptide or other product that functions downstream or upstream of its position within the signaling pathway (e.g., feedback loops). Such feedback loops are well-known in the art (see, for example, Chen and Guillemin (2009) *Int. J Tryptophan Res.* 2:1-19).

The present invention further pertains to novel agents identified by the above-described screening assays. Accordingly, it is within the scope of this invention to further use an agent identified as described herein in an appropriate animal model. For example, an agent identified as described herein can be used in an animal model to determine the efficacy, toxicity, or side effects of treatment with such an agent. Alternatively, an antibody identified as described herein can be used in an animal model to determine the mechanism of action of such an agent.

b. Predictive Medicine

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining the amount and/or activity level of a biomarker listed in Table 1 in the context of a biological sample (e.g., blood, serum, cells, or tissue) to thereby determine whether an individual afflicted with a cancer is likely to respond to immune checkpoint therapy, whether in an original or recurrent cancer. Such assays can be used for prognostic or predictive purpose to thereby prophylactically treat an individual prior to the onset or after recurrence of a disorder characterized by or associated with biomarker polypeptide, nucleic acid expression or activity. The skilled artisan will appreciate that any method can use one or more (e.g., combinations) of biomarkers listed in Table 1.

Another aspect of the present invention pertains to monitoring the influence of agents (e.g., drugs, compounds, and small nucleic acid-based molecules) on the expression or activity of a biomarker listed in Table 1. These and other agents are described in further detail in the following sections.

The skilled artisan will also appreciate that, in certain embodiments, the methods of the present invention implement a computer program and computer system. For example, a computer program can be used to perform the algorithms described herein. A computer system can also store and manipulate data generated by the methods of the present invention which comprises a plurality of biomarker signal changes/profiles which can be used by a computer system in implementing the methods of this invention. In certain embodiments, a computer system receives biomarker expression data; (ii) stores the data; and (iii) compares the data in any number of ways described herein (e.g., analysis relative to appropriate controls) to determine the state of informative biomarkers from cancerous or pre-cancerous tissue. In other embodiments, a computer system (i) compares the determined expression biomarker level to a threshold value; and (ii) outputs an indication of whether said biomarker level is significantly modulated (e.g., above or below) the threshold value, or a phenotype based on said indication.

In certain embodiments, such computer systems are also considered part of the present invention. Numerous types of computer systems can be used to implement the analytic methods of this invention according to knowledge possessed by a skilled artisan in the bioinformatics and/or computer arts. Several software components can be loaded into memory during operation of such a computer system. The software components can comprise both software components that are standard in the art and components that are special to the present invention (e.g., dCHIP software described in Lin et al. (2004) *Bioinformatics* 20, 1233-1240; radial basis machine learning algorithms (RBM) known in the art).

The methods of the present invention can also be programmed or modeled in mathematical software packages that allow symbolic entry of equations and high-level specification of processing, including specific algorithms to be used, thereby freeing a user of the need to procedurally program individual equations and algorithms. Such packages include, e.g., Matlab from Mathworks (Natick, Mass.), Mathematica from Wolfram Research (Champaign, Ill.) or S-Plus from MathSoft (Seattle, Wash.).

In certain embodiments, the computer comprises a database for storage of biomarker data. Such stored profiles can be accessed and used to perform comparisons of interest at a later point in time. For example, biomarker expression profiles of a sample derived from the non-cancerous tissue of a subject and/or profiles generated from population-based distributions of informative loci of interest in relevant populations of the same species can be stored and later compared to that of a sample derived from the cancerous tissue of the subject or tissue suspected of being cancerous of the subject.

In addition to the exemplary program structures and computer systems described herein, other, alternative program structures and computer systems will be readily apparent to the skilled artisan. Such alternative systems, which do not depart from the above described computer system and programs structures either in spirit or in scope, are therefore intended to be comprehended within the accompanying claims.

c. Diagnostic Assays

The present invention provides, in part, methods, systems, and code for accurately classifying whether a biological sample is associated with a cancer that is likely to respond to immune checkpoint therapy. In some embodiments, the present invention is useful for classifying a sample (e.g., from a subject) as associated with or at risk for responding to or not responding to immune checkpoint therapy using a statistical algorithm and/or empirical data (e.g., the amount or activity of a biomarker listed in Table 1).

An exemplary method for detecting the amount or activity of a biomarker listed in Table 1, and thus useful for classifying whether a sample is likely or unlikely to respond to immune checkpoint therapy involves obtaining a biological sample from a test subject and contacting the biological sample with an agent, such as a protein-binding agent like an antibody or antigen-binding fragment thereof, or a nucleic acid-binding agent like an oligonucleotide, capable of detecting the amount or activity of the biomarker in the biological sample. In some embodiments, at least one antibody or antigen-binding fragment thereof is used, wherein two, three, four, five, six, seven, eight, nine, ten, or more such antibodies or antibody fragments can be used in combination (e.g., in sandwich ELISAs) or in serial. In certain instances, the statistical algorithm is a single learning statistical classifier system. For example, a single learning statistical classifier system can be used to classify a sample as a based upon a prediction or probability value and the presence or level of the biomarker. The use of a single learning statistical classifier system typically classifies the sample as, for example, a likely immune checkpoint therapy responder or progressor sample with a sensitivity, specificity, positive predictive value, negative predictive value, and/or overall accuracy of at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Other suitable statistical algorithms are well known to those of skill in the art. For example, learning statistical classifier systems include a machine learning algorithmic technique capable of adapting to complex data sets (e.g., panel of markers of interest) and making decisions based upon such data sets. In some embodiments, a single learning statistical classifier system such as a classification tree (e.g., random forest) is used. In other embodiments, a combination of 2, 3, 4, 5, 6, 7, 8, 9, 10, or more learning statistical classifier systems are used, preferably in tandem. Examples of learning statistical classifier systems include, but are not limited to, those using inductive learning (e.g., decision/classification trees such as random forests, classification and regression trees (C&RT), boosted trees, etc.), Probably Approximately Correct (PAC) learning, connectionist learning (e.g., neural networks (NN), artificial neural networks (ANN), neuro fuzzy networks (NFN), network structures, perceptrons such as multi-layer perceptrons, multi-layer feed-forward networks, applications of neural networks, Bayesian learning in belief networks, etc.), reinforcement learning (e.g., passive learning in a known environment such as naive learning, adaptive dynamic learning, and temporal difference learning, passive learning in an unknown environment, active learning in an unknown environment, learning action-value functions, applications of reinforcement learning, etc.), and genetic algorithms and evolutionary programming. Other learning statistical classifier systems include support vector machines (e.g., Kernel methods), multivariate adaptive regression splines (MARS), Levenberg-Marquardt algorithms, Gauss-Newton algorithms, mixtures of Gaussians, gradient descent algorithms, and learning vector quantization (LVQ). In certain embodiments, the method of the present invention further comprises sending the sample classification results to a clinician, e.g., an oncologist.

In another embodiment, the diagnosis of a subject is followed by administering to the individual a therapeutically effective amount of a defined treatment based upon the diagnosis.

In one embodiment, the methods further involve obtaining a control biological sample (e.g., biological sample from a subject who does not have a cancer or whose cancer is susceptible to immune checkpoint therapy), a biological sample from the subject during remission, or a biological sample from the subject during treatment for developing a cancer progressing despite immune checkpoint therapy.

d. Prognostic Assays

The diagnostic methods described herein can furthermore be utilized to identify subjects having or at risk of developing a cancer that is likely or unlikely to be responsive to immune checkpoint therapy. The assays described herein, such as the preceding diagnostic assays or the following assays, can be utilized to identify a subject having or at risk of developing a disorder associated with a misregulation of the amount or activity of at least one biomarker described in Table 1, such as in cancer. Alternatively, the prognostic assays can be utilized to identify a subject having or at risk for developing a disorder associated with a misregulation of the at least one biomarker described in Table 1, such as in cancer. Furthermore, the prognostic assays described herein can be used to determine whether a subject can be administered an agent (e.g., an agonist, antagonist, peptidomimetic, polypeptide, peptide, nucleic acid, small molecule, or other drug candidate) to treat a disease or disorder associated with the aberrant biomarker expression or activity.

e. Treatment Methods

The compositions described herein (including dual binding antibodies and derivatives and conjugates thereof) can be used in a variety of in vitro and in vivo therapeutic applications using the formulations and/or combinations described herein. In one embodiment, anti-immune checkpoint agents can be used to treat cancers determined to be responsive thereto. For example, antibodies that block the interaction between PD-L1, PD-L2, and/or CTLA-4 and their receptors (e.g., PD-L1 binding to PD-1, PD-L2 binding to PD-1, and the like) can be used to treat cancer in subjects identified as likely responding thereto.

6. Pharmaceutical Compositions

In another aspect, the present invention provides pharmaceutically acceptable compositions which comprise a therapeutically-effective amount of an agent that modulates (e.g., decreases) biomarker expression and/or activity, formulated together with one or more pharmaceutically acceptable carriers (additives) and/or diluents. As described in detail below, the pharmaceutical compositions of the present invention may be specially formulated for administration in solid or liquid form, including those adapted for the following: (1) oral administration, for example, drenches (aqueous or non-aqueous solutions or suspensions), tablets, boluses, powders, granules, pastes; (2) parenteral administration, for example, by subcutaneous, intramuscular or intravenous injection as, for example, a sterile solution or suspension; (3) topical application, for example, as a cream, ointment or spray applied to the skin; (4) intravaginally or intrarectally, for example, as a pessary, cream or foam; or (5) aerosol, for example, as an aqueous aerosol, liposomal preparation or solid particles containing the compound.

The phrase "therapeutically-effective amount" as used herein means that amount of an agent that modulates (e.g., inhibits) biomarker expression and/or activity, or expression and/or activity of the complex, or composition comprising an agent that modulates (e.g., inhibits) biomarker expression and/or activity, or expression and/or activity of the complex, which is effective for producing some desired therapeutic effect, e.g., cancer treatment, at a reasonable benefit/risk ratio.

The phrase "pharmaceutically acceptable" is employed herein to refer to those agents, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, solvent or encapsulating material, involved in carrying or transporting the subject chemical from one organ, or portion of the body, to another organ, or portion of the body. Each carrier must be "acceptable" in the sense of being compatible with the other ingredients of the formulation and not injurious to the subject. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) phosphate buffer solutions; and (21) other non-toxic compatible substances employed in pharmaceutical formulations.

The term "pharmaceutically-acceptable salts" refers to the relatively non-toxic, inorganic and organic acid addition salts of the agents that modulates (e.g., inhibits) biomarker expression and/or activity, or expression and/or activity of the complex encompassed by the present invention. These salts can be prepared in situ during the final isolation and purification of the respiration uncoupling agents, or by separately reacting a purified respiration uncoupling agent in its free base form with a suitable organic or inorganic acid, and isolating the salt thus formed. ReRepresentative salts include the hydrobromide, hydrochloride, sulfate, bisulfate, phosphate, nitrate, acetate, valerate, oleate, palmitate, stearate, laurate, benzoate, lactate, phosphate, tosylate, citrate, maleate, fumarate, succinate, tartrate, napthylate, mesylate, glucoheptonate, lactobionate, and laurylsulphonate salts and the like (See, for example, Berge et al. (1977) "Pharmaceutical Salts", *J. Pharm. Sci.* 66:1-19).

In other cases, the agents useful in the methods of the present invention may contain one or more acidic functional groups and, thus, are capable of forming pharmaceutically-acceptable salts with pharmaceutically-acceptable bases. The term "pharmaceutically-acceptable salts" in these instances refers to the relatively non-toxic, inorganic and organic base addition salts of agents that modulates (e.g., inhibits) biomarker expression and/or activity, or expression and/or activity of the complex. These salts can likewise be prepared in situ during the final isolation and purification of the respiration uncoupling agents, or by separately reacting the purified respiration uncoupling agent in its free acid form with a suitable base, such as the hydroxide, carbonate or bicarbonate of a pharmaceutically-acceptable metal cation, with ammonia, or with a pharmaceutically-acceptable organic primary, secondary or tertiary amine. ReRepresentative alkali or alkaline earth salts include the lithium, sodium, potassium, calcium, magnesium, and aluminum salts and the like. ReRepresentative organic amines useful for the formation of base addition salts include ethylamine, diethylamine, ethylenediamine, ethanolamine, diethanolamine, piperazine and the like (see, for example, Berge et al., supra).

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically-acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Formulations useful in the methods of the present invention include those suitable for oral, nasal, topical (including buccal and sublingual), rectal, vaginal, aerosol and/or parenteral administration. The formulations may conveniently be presented in unit dosage form and may be prepared by any methods well known in the art of pharmacy. The amount of active ingredient which can be combined with a carrier material to produce a single dosage form will vary depending upon the host being treated, the particular mode of administration. The amount of active ingredient, which can be combined with a carrier material to produce a single dosage form will generally be that amount of the compound which produces a therapeutic effect. Generally, out of one hundred percent, this amount will range from about 1 percent to about ninety-nine percent of active ingredient, preferably from about 5 percent to about 70 percent, most preferably from about 10 percent to about 30 percent.

Methods of preparing these formulations or compositions include the step of bringing into association an agent that modulates (e.g., inhibits) biomarker expression and/or activity, with the carrier and, optionally, one or more accessory ingredients. In general, the formulations are prepared by uniformly and intimately bringing into association a respiration uncoupling agent with liquid carriers, or finely divided solid carriers, or both, and then, if necessary, shaping the product.

Formulations suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a respiration uncoupling agent as an active ingredient. A compound may also be administered as a bolus, electuary or paste.

In solid dosage forms for oral administration (capsules, tablets, pills, dragees, powders, granules and the like), the active ingredient is mixed with one or more pharmaceutically-acceptable carriers, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets and pills, the pharmaceutical compositions may also comprise buffering agents. Solid compositions of a similar type may also be employed as fillers in soft and hard-filled gelatin capsules using such excipients as lactose or milk sugars, as well as high molecular weight polyethylene glycols and the like.

A tablet may be made by compression or molding, optionally with one or more accessory ingredients. Compressed tablets may be prepared using binder (for example, gelatin or hydroxypropylmethyl cellulose), lubricant, inert diluent, preservative, disintegrant (for example, sodium starch glycolate or cross-linked sodium carboxymethyl cellulose), surface-active or dispersing agent. Molded tablets may be made by molding in a suitable machine a mixture of the powdered peptide or peptidomimetic moistened with an inert liquid diluent.

Tablets, and other solid dosage forms, such as dragees, capsules, pills and granules, may optionally be scored or prepared with coatings and shells, such as enteric coatings and other coatings well known in the pharmaceutical-formulating art. They may also be formulated so as to provide slow or controlled release of the active ingredient therein using, for example, hydroxypropylmethyl cellulose in varying proportions to provide the desired release profile, other polymer matrices, liposomes and/or microspheres. They may be sterilized by, for example, filtration through a bacteria-retaining filter, or by incorporating sterilizing agents in the form of sterile solid compositions, which can be dissolved in sterile water, or some other sterile injectable medium immediately before use. These compositions may also optionally contain opacifying agents and may be of a composition that they release the active ingredient(s) only, or preferentially, in a certain portion of the gastrointestinal tract, optionally, in a delayed manner. Examples of embedding compositions, which can be used include polymeric substances and waxes. The active ingredient can also be in micro-encapsulated form, if appropriate, with one or more of the above-described excipients.

Liquid dosage forms for oral administration include pharmaceutically acceptable emulsions, microemulsions, solutions, suspensions, syrups and elixirs. In addition to the active ingredient, the liquid dosage forms may contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof.

Besides inert diluents, the oral compositions can also include adjuvants such as wetting agents, emulsifying and suspending agents, sweetening, flavoring, coloring, perfuming and preservative agents.

Suspensions, in addition to the active agent may contain suspending agents as, for example, ethoxylated isostearyl alcohols, polyoxyethylene sorbitol and sorbitan esters, microcrystalline cellulose, aluminum metahydroxide, bentonite, agar-agar and tragacanth, and mixtures thereof.

Formulations for rectal or vaginal administration may be presented as a suppository, which may be prepared by mixing one or more respiration uncoupling agents with one or more suitable nonirritating excipients or carriers comprising, for example, cocoa butter, polyethylene glycol, a suppository wax or a salicylate, and which is solid at room temperature, but liquid at body temperature and, therefore, will melt in the rectum or vaginal cavity and release the active agent.

Formulations which are suitable for vaginal administration also include pessaries, tampons, creams, gels, pastes, foams or spray formulations containing such carriers as are known in the art to be appropriate.

Dosage forms for the topical or transdermal administration of an agent that modulates (e.g., inhibits) biomarker expression and/or activity include powders, sprays, ointments, pastes, creams, lotions, gels, solutions, patches and inhalants. The active component may be mixed under sterile conditions with a pharmaceutically-acceptable carrier, and with any preservatives, buffers, or propellants which may be required.

The ointments, pastes, creams and gels may contain, in addition to a respiration uncoupling agent, excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain, in addition to an agent that modulates (e.g., inhibits) biomarker expression and/or activity, excipients such as lactose, talc, silicic acid, aluminum hydroxide, calcium silicates and polyamide powder, or mixtures of these substances. Sprays can additionally contain customary propellants, such as chlorofluorohydrocarbons and volatile unsubstituted hydrocarbons, such as butane and propane.

The agent that modulates (e.g., inhibits) biomarker expression and/or activity, can be alternatively administered by aerosol. This is accomplished by preparing an aqueous aerosol, liposomal preparation or solid particles containing the compound. A nonaqueous (e.g., fluorocarbon propellant) suspension could be used. Sonic nebulizers are preferred because they minimize exposing the agent to shear, which can result in degradation of the compound.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Transdermal patches have the added advantage of providing controlled delivery of a respiration uncoupling agent to the body. Such dosage forms can be made by dissolving or dispersing the agent in the proper medium. Absorption enhancers can also be used to increase the flux of the peptidomimetic across the skin. The rate of such flux can be controlled by either providing a rate controlling membrane or dispersing the peptidomimetic in a polymer matrix or gel.

Ophthalmic formulations, eye ointments, powders, solutions and the like, are also contemplated as being within the scope of this invention.

Pharmaceutical compositions of this invention suitable for parenteral administration comprise one or more respiration uncoupling agents in combination with one or more pharmaceutically-acceptable sterile isotonic aqueous or nonaqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents.

Examples of suitable aqueous and nonaqueous carriers which may be employed in the pharmaceutical compositions of the present invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of the action of microorganisms may be ensured by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution, which, in turn, may depend upon crystal size and crystalline form. Alternatively, delayed absorption of a parenterally-administered drug form is accomplished by dissolving or suspending the drug in an oil vehicle.

Injectable depot forms are made by forming microencapsule matrices of an agent that modulates (e.g., inhibits) biomarker expression and/or activity, in biodegradable polymers such as polylactide-polyglycolide. Depending on the ratio of drug to polymer, and the nature of the particular polymer employed, the rate of drug release can be controlled. Examples of other biodegradable polymers include poly(orthoesters) and poly(anhydrides). Depot injectable formulations are also prepared by entrapping the drug in liposomes or microemulsions, which are compatible with body tissue.

When the respiration uncoupling agents of the present invention are administered as pharmaceuticals, to humans and animals, they can be given per se or as a pharmaceutical composition containing, for example, 0.1 to 99.5% (more preferably, 0.5 to 90%) of active ingredient in combination with a pharmaceutically acceptable carrier.

Actual dosage levels of the active ingredients in the pharmaceutical compositions of this invention may be determined by the methods of the present invention so as to obtain an amount of the active ingredient, which is effective to achieve the desired therapeutic response for a particular subject, composition, and mode of administration, without being toxic to the subject.

The nucleic acid molecules of the present invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Nat. Acad. Sci. USA* 91:3054 3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The present invention also encompasses kits for detecting and/or modulating biomarkers described herein. A kit of the present invention may also include instructional materials disclosing or describing the use of the kit or an antibody of the disclosed invention in a method of the disclosed invention as provided herein. A kit may also include additional components to facilitate the particular application for which the kit is designed. For example, a kit may additionally contain means of detecting the label (e.g., enzyme substrates for enzymatic labels, filter sets to detect fluorescent labels, appropriate secondary labels such as a sheep anti-mouse-HRP, etc.) and reagents necessary for controls (e.g., control biological samples or standards). A kit may additionally include buffers and other reagents recognized for use in a method of the disclosed invention. Non-limiting examples include agents to reduce non-specific binding, such as a carrier protein or a detergent.

EXEMPLIFICATION

This invention is further illustrated by the following examples, which should not be construed as limiting.

Example 1: Materials and Methods for Examples 2-3 a. Meta-Analysis: Cohort Consolidation

Mutation annotation files, HLA types, and clinical annotations were obtained from published data. Standardized pipelines for somatic variant calling, mutational signature deconvolution, and neoantigen prediction were used. Patients were stratified into clinical benefit (CB) and no clinical benefit (NCB) as described in Van Allen et al. (2015) *Science* 350:207-211. Analyses were repeated using two other published response metrics (CB=PFS>6 months; CB=CR or PR; see at least Rizvi et al. (2015) *Science* 348:124-128 and Snyder et al. (2014) *N. Engl. J Med.* 371:2189-2199).

Specifically, pre-treatment tumors from patients who received immune checkpoint blockade for metastatic cancer at the DFCI and partner institutions were sequenced at the Broad Institute (FIG. 1). Data sources listed in FIG. 1 include data from Zaretsky et al. (2016) *New Engl. J Med.* 375:819-829 disclosing 4 patients treated with anti-PD-1 therapy for metastatic melanoma (Zaretsky); Van Allen et al. (2015) *Science* 350:207-211 disclosing treatment of metastatic melanoma patients across Germany with anti-CTLA-4 ipilimumab therapy (Schadendorf); Hugo et al. (2016) *Cell* 165:35-44 (Hugo); Rizvi et al. (2015) *Science* 348:124-128 (Rizvi); Snyder et al. (2014) *N. Engl. J Med.* 371:2189-2199 (Synder); and samples obtained from patients treated with immune checkpoint therapies with clinical monitoring at the Dana-Farber Cancer Institute (DFCI, CANSEQ, Broad-Next10, and Rizwan Haq). For example, samples from 2 patients for WES obtained from Dana-Farber Cancer Institute attending physician, Rizwan Haq (Rizwan Haq). Cancer types included melanoma, non-small-cell lung cancer, bladder cancer, anal cancer, sarcoma, head and neck squamous cell carcinoma, including one previously published cohort in Van Allen et al. (2015) *Science* 350:207-211. Quality controls were included based on exclusion criteria and inclusion criteria (FIG. 2).

In addition, whole exome data from published clinical cohorts of patients who received immune checkpoint therapy for metastatic non-small-cell lung cancer (Rizvi et al. (2015) *Science* 348:124-128) and melanoma (Snyder et al. (2014) *N. Engl. J. Med.* 371:2189-2199; Hugo et al. (2016) *Cell* 165:35-44) were used in the meta-analysis.

In separate meta-analyses described in Example 3 below, mutation annotation files, HLA types, and clinical annotations were obtained from published data. In particular, published mutation annotation files (MAFs), clinical annotations, and neoantigen files were taken from the supplemental information of Rizvi et al. (2015) *Science* 348:124-128; Van Allen et al. (2015) *Science* 350:207-211; and Snyder et al. (2014) *N. Engl. J Med.* 371:2189-2199. These files were joined to form the meta-analysis cohort. Enrichment in mutations in specific genes was assessed in this joined cohort using Fisher's exact test. The joined MAF was also processed through MutSigCV to identify genes significantly mutated throughout the cohort. Thus, standardized pipelines for somatic variant calling, mutational signature deconvolution, and neoantigen prediction were used. Patients were stratified into clinical benefit (CB) and no clinical benefit (NCB) as described in Van Allen et al. (2015) *Science* 350:207-211. Analyses were repeated using two other published response metrics (CB=PFS>6 months; CB=CR or PR).

b. Sample Preparation, DNA and RNA Extraction, and Sequencing

Sample preparation, DNA and RNA extraction, and sequencing information vary slightly between the studies described in Rizvi et al. (2015) *Science* 348:124-128; Van Allen et al. (2015) *Science* 350:207-211; and Snyder et al. (2014) *N. Engl. J Med.* 371:2189-2199, and particular details of such methods used can be found in the supplemental information files of these three publications.

For other samples, such as metastatic melanoma samples described in Example 3, or unless otherwise described, sample preparation, DNA and RNA extraction, and sequencing information proceeded as described below. Briefly, after fixation and mounting, 5-10 10 µm slices from formalin-fixed, paraffin-embedded (FFPE) tumor blocks were obtained, and tumor-enriched tissue was macrodissected. Paraffin was removed from FFPE sections and cores using CitriSolv™ (Fisher Scientific, Hampton, NH), followed by ethanol washes and tissue lysis overnight at 56° C. Samples were then incubated at 90° C. to remove DNA crosslinks, and DNA- and when possible, RNA-extraction was performed using Qiagen AllPrep DNA/RNA Mini Kit (#51306, Qiagen, Hilden, Germany). Germline DNA was obtained from adjacent PBMCs.

Whole exome and whole transcriptome sequencing of tumor and germline samples were performed as previously described (Van Allen et al. (2015) *Science* 350:207-211; Van Allen et al. (2014) *Nat. Med.* 20:682-688). All samples in the training cohort were sequenced using the Illumina exome, while a portion of the samples in the validation cohort were sequenced using the Agilent exome (Table 3A). The Illumina exome uses Illumina's in-solution DNA probe based hybrid selection method to target approximately 37.7 Mb of mainly exonic territory, using similar principles as the Broad Institute-Agilent Technologies developed in-solution RNA probe based hybrid selection method (Agilent SureSelect™ All Exon V2) (Fisher et al. (2011) *Genome Biol.* 12:R1; Gnirke et al. (2009) *Nat. Biotechnol.* 27:182-189) to generate Illumina exome sequencing libraries.

Pooled libraries were normalized to 2 nM and denatured using 0.2 N NaOH prior to sequencing. Flowcell cluster amplification and sequencing were performed according to the manufacturer's protocols using either the HiSeq 2000 v3 or HiSeq 2500. Each run was a 76 bp paired-end with a dual eight-base index barcode read. Data was analyzed using the Broad Picard Pipeline, which includes de-multiplexing and data aggregation.

Exome sequence data processing was performed using established analytical pipelines at the Broad Institute. A BAM file was produced using the Picard pipeline (at the World Wide Web address of picard.sourceforge.net), which aligns the tumor and normal sequences to the hg19 human genome build using Illumina sequencing reads. The BAM was uploaded into the Firehose pipeline (at the World Wide Web address of broadinstitute.org/cancer/cga/Firehose), which manages input and output files to be executed by GenePattern (Reich et al. (2006) *Nat. Genet.* 38:500-501). Samples with mean target coverage less than 25× in the tumor and less than 15× in matched normal were excluded. Quality control modules within Firehose were applied to all sequencing data for comparison of the origin of tumor and normal genotypes and to assess fingerprinting concordance. Cross-contamination of samples was estimated using ContEst (Cibulskis et al. (2011) *Bioinformatics* 27:2601-2602). Samples with ContEst estimates exceeding 5% were excluded from analysis.

c. Whole Exome and Whole Transcriptome Analyses

MuTect was applied to identify somatic single-nucleotide variants (Cibulskis et al. (2013) *Nat. Biotechnol.* 31:213-

219). Strelka was used to identify somatic insertions and deletions (Saunders et al. (2012) *Bioinformatics* 28:1811-1817) across the whole exome. Indelocator, which detects small insertions and deletions after local realignment of tumor and normal sequences, was additionally applied to provide further sensitivity to detect indels in PBRM1 (Cancer Genome Atlas Research (2011) *Nature* 474:609-615). The union of indels called by Strelka and Indelocator was used for final analysis. Artifacts introduced by DNA oxidation during sequencing were computationally removed using a filter-based method (Costello et al. (2013) *Nuc. Acids Res.* 41:e67). All somatic mutations detected by whole-exome sequencing were analyzed for potential false positive calls by performing a comparison to mutation calls from a panel of 2,500 germline DNA samples (Stachler et al. (2015) *Nat. Genet.* 47:1047-1055). Mutations found in germline samples were removed from analysis. Annotation of identified variants was done using Oncotator (available at the World Wide Web address of www.broadinstitute.org/cancer/cga/oncotator). All nonsynonymous alterations in PBRM1 were manually reviewed in Integrated Genomics Viewer (IGV_2.3.57) for sequencing quality (Thorvaldsdottir et al. (2013) *Brief Bioinform* 14:178-192).

Copy ratios were calculated for each captured target by dividing the tumor coverage by the median coverage obtained in a set of reference normal samples. The resulting copy ratios were segmented using the circular binary segmentation algorithm (Olshen et al. (2004) *Biostatistics* 5:557-572). Allelic copy number alterations were called while taking into account sample-specific overall chromosomal aberrations (focality) (Brastianos et al. (2015) *Cancer Discov.* 5:1164-1177). Inference of mutational clonality, tumor purity, and tumor ploidy was accomplished with ABSOLUTE (Carter et al. (2012) *Nat Biotechnol.* 30:413-421). Samples had to have estimated tumor purity greater than 10% to be included in the final analysis. As a final quality control metric to ensure adequate sequencing coverage and tumor purity to detect relevant oncogenic events, all samples had to have at least one nonsynonymous mutation in at least one high confidence or candidate cancer driver gene to be included in the final analysis (Tamborero et al. (2013) *Sci. Rep.* 3:2650).

The 4-digit HLA type for each sample was inferred using Polysolver (Shukla et al. (2015) *Nat. Biotechnol.* 33:1152-1158). Neo-epitopes were predicted for each patient by defining all novel amino acid 9mers and 10mers resulting from each single nucleotide polymorphism and indel and determining whether the predicted binding affinity to the patient's germline HLA alleles was <500 nM using NetMHCpan (v2.4) (Hoof et al. (2009) *Immunogenetics* 61:1-13; Karosiene et al. (2013) *Immunogenetics* 65:711-724; Nielsen et al. (2007) *PLoS One* 2:e796).

Statistical analyses were also applied and are described further herein.

Example 2: Meta-Analysis of Genomic Predictors of Response to Immune Checkpoint Therapy Across a Variety of Cancers A large cohort of whole-exome-sequenced pre-treatment tumors were gathered from subjects who received immune checkpoint therapies for various cancers, were gathered and assessed for mutations associated with differential response to immune checkpoint therapies. Tumor types included in this discovery cohort included bladder cancer, renal cell carcinoma, lung cancer, and head and neck squamous cell carcinoma. Tumor-specific (somatic) mutations were assessed in all sequenced tumors to generate mutation annotation files (MAFs), which were later joined with MAFs from previously published studies in clinical cohorts in melanoma (Van Allen et al. (2015) *Science* 350:207-211; Snyder et al. (2014) *N. Engl. J. Med.* 371:2189-2199; Hugo et al. (2016) *Cell* 165:35-44) and non-small cell lung cancer (Rizvi et al. (2015) *Science* 348:124-128).

In particular, pre-treatment samples from cancer patients (N=268) were tested for their genetic sequences in relation to results of immune checkpoint therapy experienced by the cancer patients (FIG. 3). The results are shown in Table 2 as response by cancer type.

TABLE 2

|  | Melanoma | Lung | HNSCC | Sarcoma | Bladder |
|---|---|---|---|---|---|
| Clinical benefit | 66 (38.6%) | 20 (29.4%) | 4 (28.6%) | 1 (100%) | 6 (46.2%) |
| Intermediate benefit | 6 (3.5%) | 23 (33.8%) | 3 (21.4%) | 0 | 1 (7.7%) |
| No clinical benefit | 96 (56.1%) | 25 (36.8%) | 7 (50.0%) | 0 | 4 (30.8%) |
| Mixed response or not evaluable | 3 (1.8%) | 0 | 0 | 0 | 2 (1.5%) |
| Total | 171 | 68 | 14 | 1 | 13 |

Nonsynonymous mutational burden is a strong predictor of clinical outcomes across cancer types. As shown in FIG. 4, patients experiencing clinical benefit to immune checkpoint therapy had significantly more nonsynonymous mutations than those experiencing no clinical benefit (p=5.52e-06; Wilcoxon rank-sum). Such relationship is strong for patients with lung cancer (p=5.2e-05) and also significant for patients with bladder cancer (p=0.019) and melanoma (p=0.0016). No relationship between clinical outcome and mutational burden in HNSCC (p=0.45) was found. In addition, complete responders in sarcoma and anal cancer had unexceptional mutational burdens (below and near median, respectively).

In order to identify biomarkers associated with response or nonresponse to immune checkpoint blockade, the following procedure was conducted:

Split all patients into responders and non-responders
   Version A: N=98 CB vs. N=132 NCB
   Version B: N=98 CB vs. N=165 NCB or IB
Calculate significance value for enrichment of mutations in a given gene in responder or non-responders (Fisher's exact test)
   Version A: All nonsynonymous mutations
   Version B: Only truncating alterations (frame-shift insertions and deletions, nonsense single nucleotide polymorphisms, splice-site alterations)
Run MutSigCV on all 268 patients with called mutations to determine significantly mutated genes across the entire cohort, which takes into account gene size, patient-specific mutational rate, mutational spectra, and gene replication rates and times Select genes that are mutated significantly more often in responders or non-responders (p<0.05) and pass MutSigCV significance (q<0.1; FDR).

Figure 5:
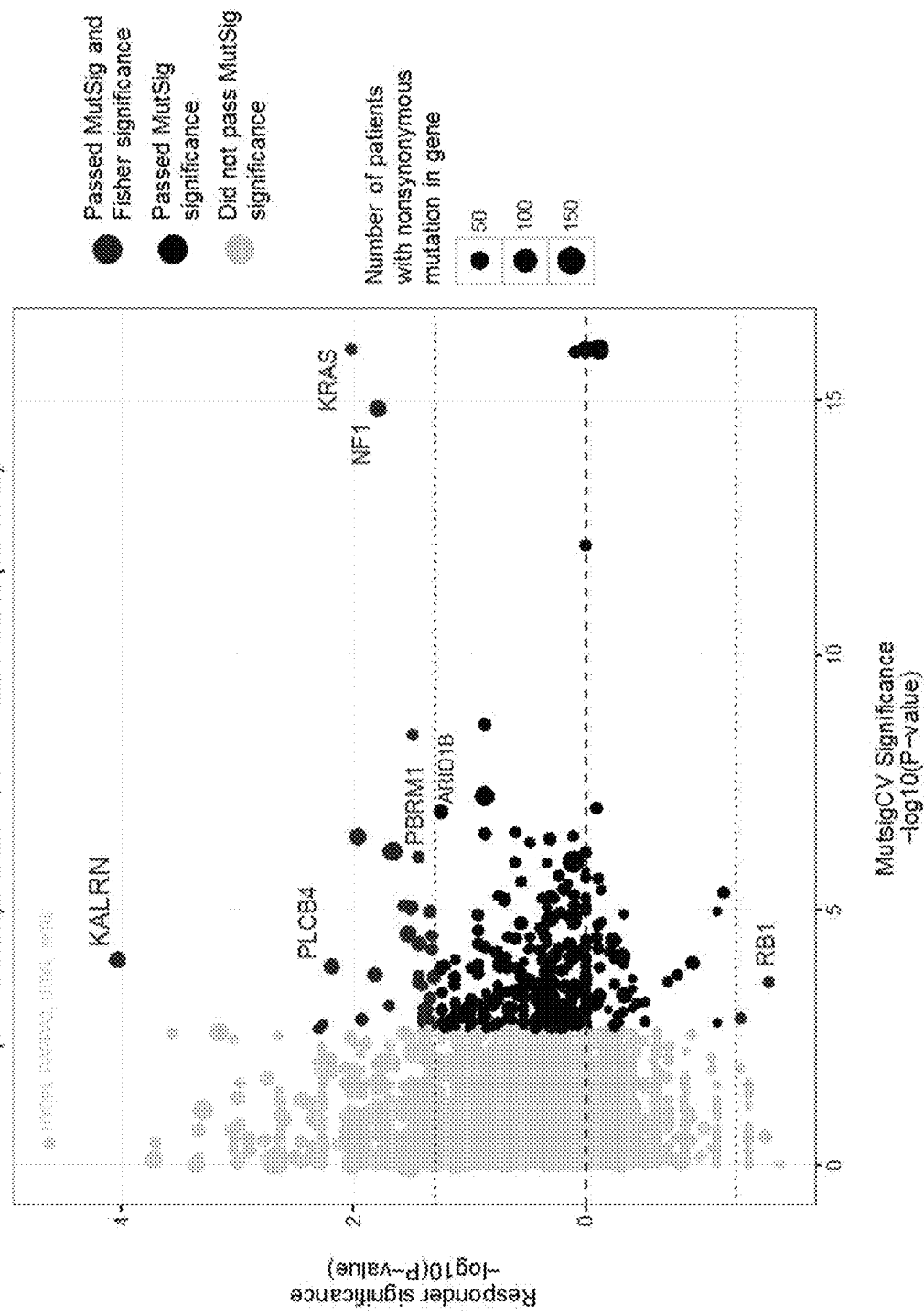
FIG. 5 shows genes significantly mutated in responders vs. non-responders.

The identified biomarkers are shown in FIG. 5. Table 3 is a summary of all genes with significantly more nonsynonymous mutations in R (N=98) or NR (N=132).

TABLE 3

| Gene | N (R) | N (NR) | p-value (Fisher's exact) |
|---|---|---|---|
| CETP | 4 | 0 | 0.032 |
| COL3A1 | 18 | 10 | 0.015 |
| COL5A1 | 22 | 15 | 0.029 |
| DDX60 | 13 | 5 | 0.012 |
| DHX8 | 10 | 2 | 0.005 |
| DLEC1 | 16 | 9 | 0.031 |
| DNAH2 | 23 | 14 | 0.011 |
| FHOD1 | 8 | 2 | 0.020 |
| HK3 | 7 | 2 | 0.040 |
| KALRN | 27 | 10 | 0.000093 |
| KIF21B | 15 | 9 | 0.049 |
| KIF5A | 11 | 5 | 0.036 |
| KRAS | 11 | 3 | 0.0095 |
| MCTP1 | 12 | 6 | 0.045 |
| MGAM | 33 | 26 | 0.022 |
| NARS2 | 6 | 0 | 0.0055 |
| ZNF253 | 10 | 4 | 0.047 |
| NF1 | 25 | 17 | 0.016 |
| *NR1H4* | 2 | 11 | 0.046 |
| PBRM1 | 10 | 4 | 0.047 |
| PKP1 | 7 | 2 | 0.040 |
| PLCB4 | 21 | 11 | 0.0065 |
| POLR2A | 10 | 4 | 0.047 |
| PREX2 | 25 | 19 | 0.042 |
| *RB1* | 1 | 10 | 0.026 |
| ROCK1 | 8 | 2 | 0.020 |
| SAFB2 | 9 | 3 | 0.032 |
| SERPINB3 | 11 | 5 | 0.036 |
| SPATA16 | 12 | 6 | 0.045 |

TABLE 3-continued

| Gene | N (R) | N (NR) | p-value (Fisher's exact) |
|---|---|---|---|
| STAB1 | 17 | 10 | 0.037 |
| TGM3 | 11 | 5 | 0.036 |
| TSC1 | 13 | 6 | 0.027 |
| TSPAN2 | 7 | 2 | 0.040 |
| ZNF207 | 6 | 1 | 0.044 |

*Genes in italics (i.e., *NR1H4* and *RB1*) mutated more frequently in NR vs. R. Genes in plain text mutated more frequently in R vs. NR.
**Bolded genes (i.e., DHX8, KALRN, KRAS, NARS2, and PLCB4) have p < 0.01.

Figure 6:
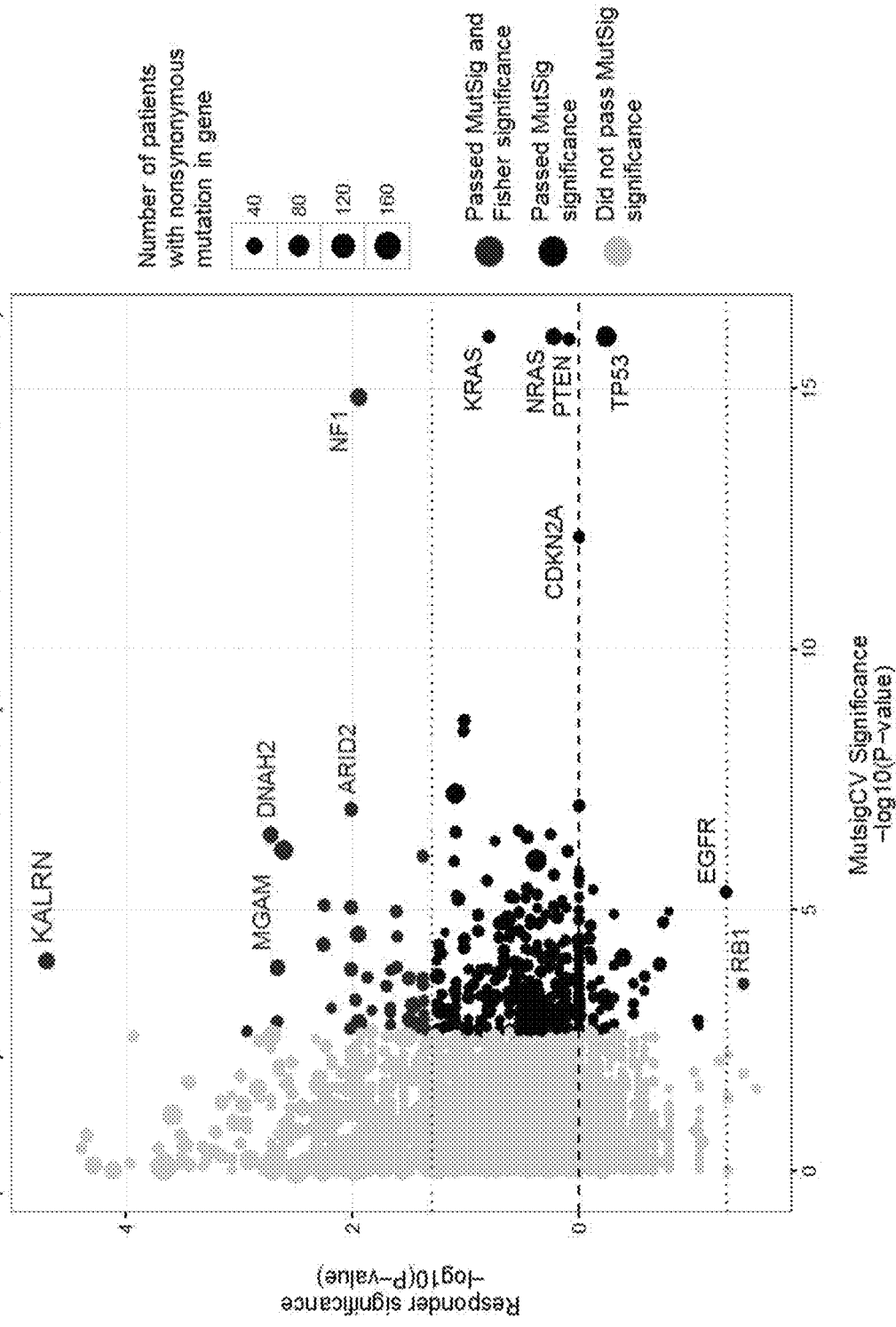
FIG. 6 shows genes significantly mutated in responders vs. non-responders or intermediate responders (such as those having intermediate clinical benefit).
Figure 7:
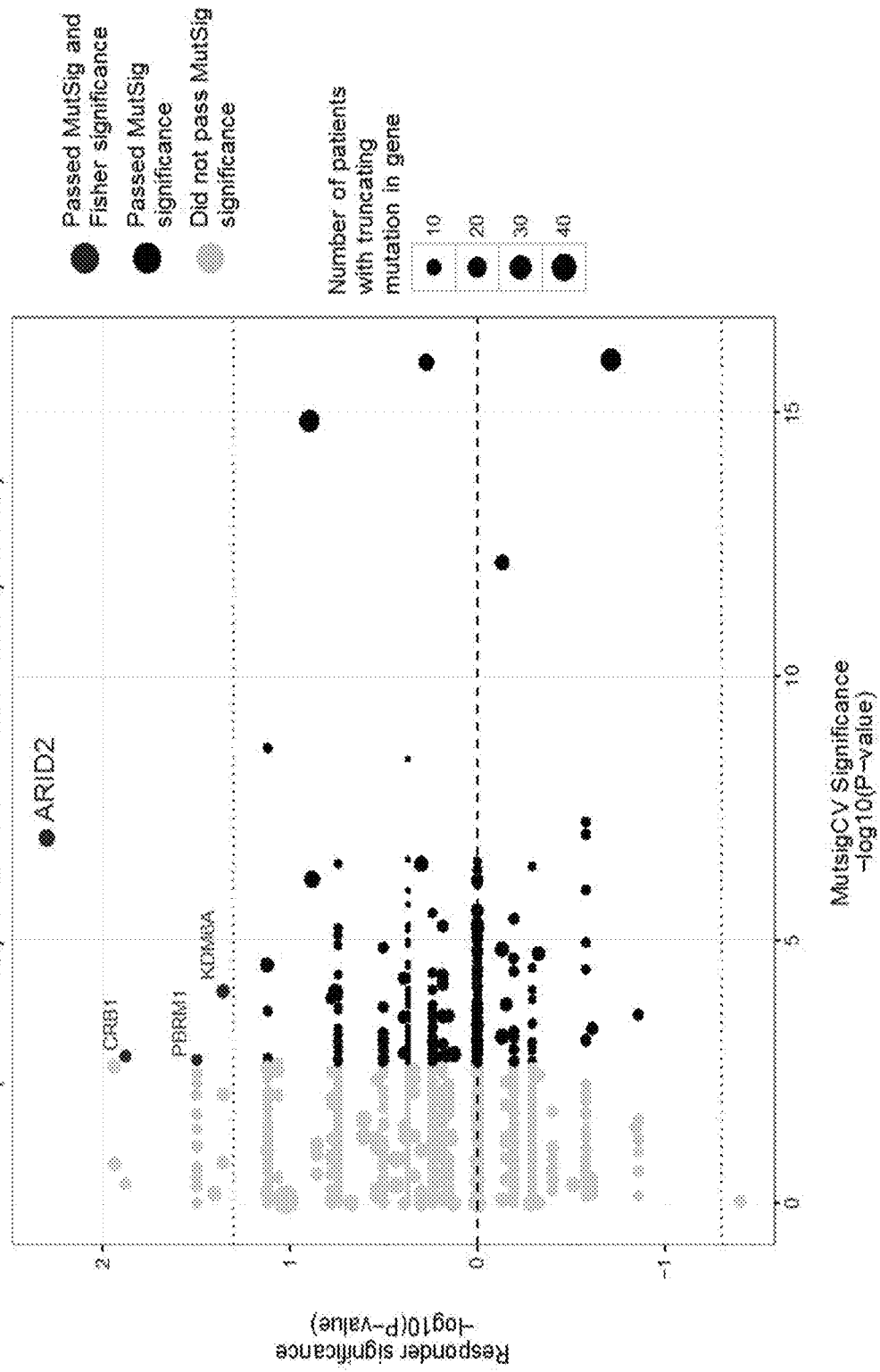
FIG. 7 shows genes significantly mutated (such as those having truncating mutations) in responders vs. non-responders.
Figure 8:
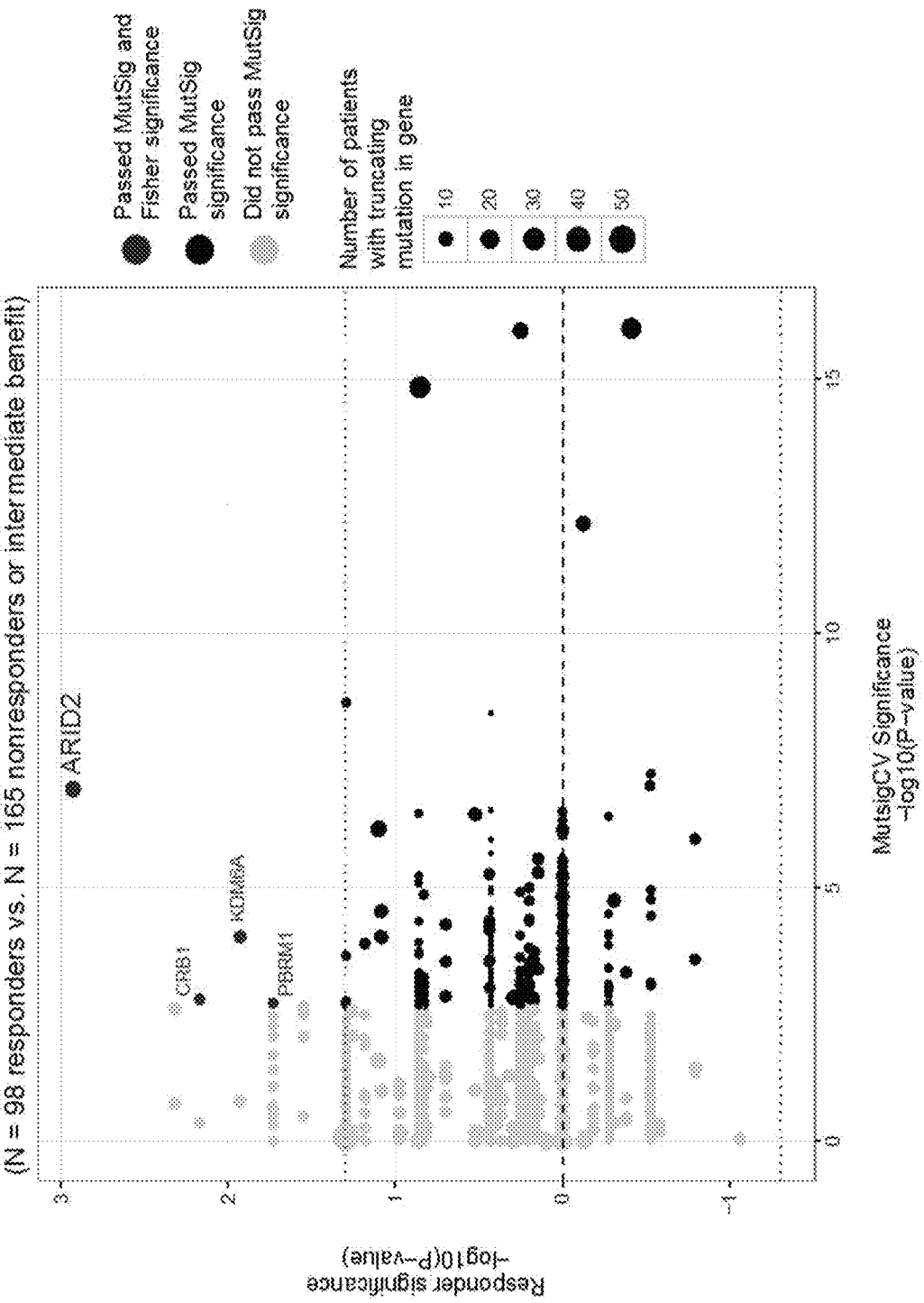
FIG. 8 shows genes significantly mutated (such as those having truncating mutations) in responders vs. non-responders or intermediate responders (those having intermediate clinical benefit).

After limiting analyses to comparing patients with objective tumor response (CR, PR, or SD by RECIST vs. PD by RECIST) in non-melanoma cancer types, it was observed that a striking association exists between mutations in one or more SWI/SNF complex subunits and response to immune checkpoint therapy (Tables 4-5 and FIGS. 6-8).

For example, truncating alterations in PBRM1 and response to immune checkpoint therapy, driven by nonsense, frameshift, and splice site mutations in bladder cancer, lung cancer, and renal cell carcinoma (9/75 responders vs. 0/41 non-responders, p=0.026). Additionally, it was observed that ARID2 truncating mutations enriched in responders in melanoma across multiple clinical cohorts (6/68 responders vs. 2/96 non-responders), as well as in isolated cases in other tumor types (one frameshift deletion in lung cancer PR and one frameshift deletion in one SD RCC). Interestingly, the two ARID2 alterations occurring in non-responders occurred in patients receiving anti-CTLA4 therapies (rather than anti-PD1 therapies), though one patient with PR to anti-CTLA4 also had an ARID2 splice site mutation. Lastly, it was observed that mutations in SMARCA4 were associated with response in head and neck squamous cell carcinoma (3/6 responders vs. 0/9 non-responders, p=0.044, Fisher's exact test). Thus, alterations in the SWI/SNF pathway were found to be predictive of response to immune checkpoint therapy across cancer types.

TABLE 4

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat132-Tumor-SM-5VWJA | MEL-IPI_Pat132-TP-NB-SM-5VWJA-SM-5VWHR | ACTL6A | 86 | 3 | 179294461 | 179294461 | Missense_Mutation | + |
| MEL-IPI_Pat138-Tumor-SM-5VWJG | MEL-IPI_Pat138-TP-NB-SM-5VWJG-SM-5VWHX | ACTL6A | 86 | 3 | 179298455 | 179298455 | Missense_Mutation | + |
| Pt20 | Pt20 | ACTL6A | 86 | 3 | 179294018 | 179294018 | Missense_Mutation | − |
| CR04885 | CR04885 | ACTL6B | 51412 | 7 | 100244379 | 100244379 | Missense_Mutation | + |
| Lung-DFCI-11-104-009-Tumor-SM-5YS7O | Lung-DFCI-11-104-009-TM-NB-SM-5YS70-SM-5YS7P | ACTL6B | 51412 | 7 | 100244451 | 100244451 | Missense_Mutation | + |
| MEL-IPI_Pat130-Tumor-SM-5X2R8 | MEL-IPI_Pat130-TP-NT-SM-5X2R8-SM-5X2RJ | ACTL6B | 51412 | 7 | 100247744 | 100247744 | Silent | − |
| MEL-IPI_Pat138-Tumor-SM-5VWJG | MEL-IPI_Pat138-TP-NB-SM-5VWJG-SM-5VWHX | ACTL6B | 51412 | 7 | 100240903 | 100240903 | Missense_Mutation | + |
| MEL-IPI_Pat139-Tumor-SM-5VWJH | MEL-IPI_Pat139-TP-NB-SM-5VWJH-SM-5VWHY | ACTL6B | 51412 | 7 | 100244908 | 100244908 | Splice_Site | − |
| MEL-IPI_Pat28-Tumor-SM-4DK10 | MEL-IPI_Pat28-TP-NB-SM-4DK10-SM-4NFUU | ACTL6B | 51412 | 7 | 100244416 | 100244416 | Silent | − |
| MEL-IPI_Pat38-Tumor-SM-53U3Z | MEL-IPI_Pat38-TP-NT-SM-53U3Z-SM-53U5L | ACTL6B | 51412 | 7 | 100244877 | 100244877 | Silent | + |
| MEL-IPI_Pat38-Tumor-SM-53U3Z | MEL-IPI_Pat38-TP-NT-SM-53U3Z-SM-53U5L | ACTL6B | 51412 | 7 | 100244902 | 100244902 | Silent | + |
| PR4035 | PR4035 | ACTL6B | 51412 | 7 | 100253064 | 100253064 | Missense_Mutation | + |
| Pt14 | Pt14 | ACTL6B | 51412 | 7 | 100253200 | 100253200 | Missense_Mutation | − |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| Pt4 | Pt4 | ACTL6B | 51412 | 7 | 100246273 | 100246273 | Missense_Mutation | + |
| RH090935 | RH090935 | ACTL6B | 51412 | 7 | 100253478 | 100253478 | Missense_Mutation | + |
| SD1494 | SD1494 | ACTL6B | 51412 | 7 | 100253045 | 100253045 | Splice_Site | ± |
| SU2C_Lung-SU2C-DFCI-LUAD-1011-Tumor-SM-AOL75 | SU2C_Lung-SU2C-DFCI-LUAD-1011-TM-NB-SM-AOL75-SM-A46NN | ACTL6B | 51412 | 7 | 100252740 | 100252740 | Missense_Mutation | − |
| AL4602 | AL4602 | ARID1A | 8289 | 1 | 27023633 | 27023633 | Missense_Mutation | ± |
| BLADDER-15330_CCPM_0700692-Tumor-SM-AVI11 | BLADDER-15330_CCPM_0700692-TM-NB-SM-AVI11-SM-AVHZM | ARID1A | 8289 | 1 | 27101612 | 27101612 | Frame_Shift_Del | − |
| BLCA-IM01-Tumor-SM-79XD9 | BLCA-IM01-TP-NB-SM-79XD9-SM-7AABJ | ARID1A | 8289 | 1 | 27057664 | 27057664 | Missense_Mutation | − |
| BLCA-IM01-Tumor-SM-79XD9 | BLCA-IM01-TP-NB-SM-79XD9-SM-7AABJ | ARID1A | 8289 | 1 | 27058092 | 27058097 | Splice_Site | − |
| BLCA-IM01-Tumor-SM-79XD9 | BLCA-IM01-TP-NB-SM-79XD9-SM-7AABJ | ARID1A | 8289 | 1 | 27057642 | 27057642 | Splice_Site | − |
| HNSCC-287-Tumor-SM-AXGEI | HNSCC-287-TP-NB-SM-AXGEI-SM-ADP7M | ARID1A | 8289 | 1 | 27100352 | 27100355 | Frame_Shift_Del | − |
| LO3793 | LO3793 | ARID1A | 8289 | 1 | 27105688 | 27105688 | Nonsense_Mutation | ± |
| LUAD-BS-13-F33496-Tumor-SM-9J2XU | LUAD-BS-13-F33496-TP-NB-SM-9J2XU-SM-9HBZX | ARID1A | 8289 | 1 | 27056342 | 27056343 | Frame_Shift_Del | ± |
| Lung-DFCI-11-104-009-Tumor-SM-5YS7O | Lung-DFCI-11-104-009-IM-NB-SM-5YS7O-SM-5YS7P | ARID1A | 8289 | 1 | 27106621 | 27106621 | Nonsense_Mutation | + |
| MEL-IPI_Pat7-Tumor-SM-4DK13 | MEL-IPI_Pat07-IP-NB-SM-4DK13-SM-4NFU9 | ARID1A | 8289 | 1 | 27105918 | 27105918 | Silent | + |
| MEL-IPI_Pat11-Tumor-SM-4DK17 | MEL-IPI_Pat11-TP-NB-SM-4DK17-SM-4NFUD | ARID1A | 8289 | 1 | 27101642 | 27101642 | Missense_Mutation | − |
| MEL-IPI_Pat110-Tumor-SM-4CU6X | MEL-IPI_Pat110-TP-NT-SM-4CU6X-SM-4MGPO | ARID1A | 8289 | 1 | 27106693 | 27106693 | Missense_Mutation | − |
| MEL-IPI_Pat133-Tumor-SM-5VWJB | MEL-IPI_Pat133-TP-NB-SM-5VWJB-SM-5VWHS | ARID1A | 8289 | 1 | 27089607 | 27089607 | Missense_Mutation | − |
| MEL-IPI_Pat138-Tumor-SM-5VWJG | MEL-IPI_Pat138-TP-NB-SM-5VWJG-SM-5VWHX | ARID1A | 8289 | 1 | 27023487 | 27023487 | Missense_Mutation | + |
| MEL-IPI_Pat138-Tumor-SM-5VWJG | MEL-IPI_Pat138-TP-NB-SM-5VWJG-SM-5VWHX | ARID1A | 8289 | 1 | 27106461 | 27106461 | Silent | + |
| MEL-IPI_Pat138-Tumor-SM-5VWJG | MEL-IPI_Pat138-TP-NB-SM-5VWJG-SM-5VWHX | ARID1A | 8289 | 1 | 27058070 | 27058070 | Missense_Mutation | + |
| MEL-IPI_Pat159-Tumor-SM-5VWK2 | MEL-IPI_Pat159-TP-NB-SM-5VWK2-SM-5VWIJ | ARID1A | 8289 | 1 | 27087452 | 27087452 | Missense_Mutation | − |
| MEL-IPI_Pat163-Tumor-SM-5VWK6 | MEL-IPI_Pat163-TP-NB-SM-5VWK6-SM-5VWIN | ARID1A | 8289 | 1 | 27107176 | 27107176 | Missense_Mutation | − |
| MEL-IPI_Pat37-Tumor-SM-53U3Y | MEL-IPI_Pat37-TP-NB-SM-53U3Y-SM-4NFV4 | ARID1A | 8289 | 1 | 27101712 | 27101712 | Splice_Site | − |
| MEL-IPI_Pat37-Tumor-SM-53U3Y | MEL-IPI_Pat37-TP-NB-SM-53U3Y-SM-4NFV4 | ARID1A | 8289 | 1 | 27105837 | 27105837 | Silent | − |
| MEL-IPI_Pat38-Tumor-SM-53U3Z | MEL-IPI_Pat38-TP-NT-SM-53U3Z-SM-53U5L | ARID1A | 8289 | 1 | 27087393 | 27087393 | Missense_Mutation | + |
| MEL-IPI_Pat39-Tumor-SM-4DK1Z | MEL-IPI_Pat39-TP-NB-SM-4DK1Z-SM-4NFV6 | ARID1A | 8289 | 1 | 27057822 | 27057822 | Silent | + |
| MEL-IPI_Pat62-Tumor-SM-4DK2N | MEL-IPI_Pat62-TP-NB-SM-4DK2N-SM-4NFVT | ARID1A | 8289 | 1 | 27087494 | 27087494 | Missense_Mutation | − |
| MEL-IPI_Pat64-Tumor-SM-4DK2P | MEL-IPI_Pat64-TP-NB-SM-4DK2P-SM-4NFVV | ARID1A | 8289 | 1 | 27099940 | 27099940 | Missense_Mutation | − |
| MEL-IPI_Pat85-Tumor-SM-53U2Y | MEL-IPI_Pat85-TP-NB-SM-53U2Y-SM-4NFWH | ARID1A | 8289 | 1 | 27058033 | 27058033 | Nonsense_Mutation | − |
| PR11217 | PR11217 | ARID1A | 8289 | 1 | 27093053 | 27093053 | Missense_Mutation | + |
| PR4077 | PR4077 | ARID1A | 8289 | 1 | 27089494 | 27089494 | Missense_Mutation | + |
| Pt15 | Pt15 | ARID1A | 8289 | 1 | 27101090 | 27101090 | Intron | + |
| SU2C_Lung-SU2C-DFCI-LUAD-1017-Tumor-SM-AOL99 | SU2C_Lung-SU2C-DFCI-LUAD-1017-TM-NB-SM-AOL99-SM-A46NT | ARID1A | 8289 | 1 | 27101525 | 27101525 | Frame_Shift_Del | + |
| SU2C_Lung-SU2C-DFCI-LUAD-1017-Tumor-SM-AOL99 | SU2C_Lung-SU2C-DFCI-LUAD-1017-TM-NB-SM-AOL99-SM-A46NT | ARID1A | 8289 | 1 | 27106878 | 27106878 | Frame_Shift_Del | + |
| Y2087 | Y2087 | ARID1A | 8289 | 1 | 27023360 | 27023360 | Missense_Mutation | ± |
| ZA6965 | ZA6965 | ARID1A | 8289 | 1 | 27023690 | 27023690 | Missense_Mutation | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| BLCA-IM01-Tumor-SM-79XD9 | BLCA-IM01-TP-NB-SM-79XD9-SM-7AABJ | ARID1B | 57492 | 6 | 157100005 | 157100005 | Silent | − |
| HNSCC-239-Tumor-SM-AXGCS | HNSCC-239-TP-NB-SM-AXGCS-SM-ADP7K | ARID1B | 57492 | 6 | 157100005 | 157100005 | Silent | ± |
| HNSCC-243-Tumor-SM-CLFNS | HNSCC-243-TP-NB-SM-CLFNS-SM-AV34T | ARID1B | 57492 | 6 | 157100005 | 157100005 | Silent | − |
| LUAD-BS-11-R21845-Tumor-SM-9J2YH | LUAD-BS-11-R21845-TP-NT-SM-9J2YH-SM-9J2YI | ARID1B | 57492 | 6 | 157100005 | 157100005 | Silent | + |
| LUAD-BS-13-X14864-Tumor-SM-9J2XQ | LUAD-BS-13-X14864-TP-NB-SM-9J2XQ-SM-9HBZU | ARID1B | 57492 | 6 | 157528372 | 157528372 | Missense_Mutation | ± |
| LUAD-BS-14-G65174-Tumor-SM-9J2YF | LUAD-BS-14-G65174-TP-NT-SM-9J2YF-SM-9J2YG | ARID1B | 57492 | 6 | 157100005 | 157100005 | Silent | − |
| MEL-682321-Tumor-SM-CN21G | MEL-682321-TP-NB-SM-CN21G-SM-CJP7S | ARID1B | 57492 | 6 | 157099512 | 157099512 | Missense_Mutation | + |
| MEL-682321-Tumor-SM-CN21G | MEL-682321-TP-NB-SM-CN21G-SM-CJP7S | ARID1B | 57492 | 6 | 157099511 | 157099511 | Missense_Mutation | + |
| MEL-IPI_Pat132-Tumor-SM-5VWJA | MEL-IPI_Pat132-TP-NB-SM-5VWJA-SM-5VWHR | ARID1B | 57492 | 6 | 157517305 | 157517305 | Missense_Mutation | + |
| MEL-IPI_Pat138-Tumor-SM-5VWJG | MEL-IPI_Pat138-TP-NB-SM-5VWJG-SM-5VWHX | ARID1B | 57492 | 6 | 157522597 | 157522597 | Silent | + |
| MEL-IPI_Pat138-Tumor-SM-5VWJG | MEL-IPI_Pat138-TP-NB-SM-5VWJG-SM-5VWHX | ARID1B | 57492 | 6 | 157527479 | 157527479 | Missense_Mutation | + |
| MEL-IPI_Pat138-Tumor-SM-5VWJG | MEL-IPI_Pat138-TP-NB-SM-5VWJG-SM-5VWHX | ARID1B | 57492 | 6 | 157502265 | 157502265 | Silent | + |
| MEL-IPI_Pat138-Tumor-SM-5VWJG | MEL-IPI_Pat138-TP-NB-SM-5VWJG-SM-5VWHX | ARID1B | 57492 | 6 | 157511325 | 157511325 | Silent | + |
| MEL-IPI_Pat139-Tumor-SM-5VWJH | MEL-IPI_Pat139-TP-NB-SM-5VWJH-SM-5VWHY | ARID1B | 57492 | 6 | 157527627 | 157527627 | Silent | − |
| MEL-IPI_Pat139-Tumor-SM-5VWJH | MEL-IPI_Pat139-TP-NB-SM-5VWJH-SM-5VWHY | ARID1B | 57492 | 6 | 157505558 | 157505558 | Missense_Mutation | − |
| MEL-IPI_Pat174-Tumor-SM-5VOB4 | MEL-IPI_Pat174-TP-NB-SM-5VOB4-SM-5VWIY | ARID1B | 57492 | 6 | 157528667 | 157528667 | Missense_Mutation | + |
| MEL-IPI_Pat21-Tumor-SM-4DK1H | MEL-IPI_Pat21-TP-NT-SM-4DK1H-SM-53U5G | ARID1B | 57492 | 6 | 157522222 | 157522222 | Missense_Mutation | + |
| MEL-IPI_Pat39-Tumor-SM-4DK1Z | MEL-IPI_Pat39-TP-NB-SM-4DK1Z-SM-4NFV6 | ARID1B | 57492 | 6 | 157511303 | 157511303 | Missense_Mutation | + |
| MEL-IPI_Pat74-Tumor-SM-4DK2Z | MEL-IPI_Pat74-TP-NB-SM-4DK2Z-SM-4NFW6 | ARID1B | 57492 | 6 | 157100377 | 157100377 | Silent | − |
| MEL-IPI_Pat74-Tumor-SM-4DK2Z | MEL-IPI_Pat74-TP-NB-SM-4DK2Z-SM-4NFW6 | ARID1B | 57492 | 6 | 157100376 | 157100376 | Missense_Mutation | − |
| PR11217 | PR11217 | ARID1B | 57492 | 6 | 157522344 | 157522344 | Missense_Mutation | + |
| PR4092 | PR4092 | ARID1B | 57492 | 6 | 157521990 | 157521990 | Missense_Mutation | + |
| Pt8 | Pt8 | ARID1B | 57492 | 6 | 157222594 | 157222594 | Missense_Mutation | + |
| SA9755 | SA9755 | ARID1B | 57492 | 6 | 157522508 | 157522508 | Missense_Mutation | + |
| SD1494 | SD1494 | ARID1B | 57492 | 6 | 157522095 | 157522095 | Missense_Mutation | ± |
| SU2C_Lung-SU2C-DFCI-LUAD-1006-Tumor-SM-AOL5E | SU2C_Lung-SU2C-DFCI-LUAD-1006-TP-NB-SM-AOL5E-SM-A46NI | ARID1B | 57492 | 6 | 157100005 | 157100005 | Silent | − |
| SU2C_Lung-SU2C-DFCI-LUAD-1011-Tumor-SM-AOL75 | SU2C_Lung-SU2C-DFCI-LUAD-1011-TM-NB-SM-AOL75-SM-A46NN | ARID1B | 57492 | 6 | 157222621 | 157222621 | Missense_Mutation | − |
| Y2087 | Y2087 | ARID1B | 57492 | 6 | 157099481 | 157099481 | Missense_Mutation | ± |
| Case1-BaselineTumor | Case1-TP-NB-Zaretsky | ARID2 | 196528 | 12 | 46287234 | 46287234 | Missense_Mutation | + |
| Case3-BaselineTumor | Case3-TP-NB-Zaretsky | ARID2 | 196528 | 12 | 46243857 | 46243857 | Nonsense_Mutation | + |
| HNSCC-323-Tumor-SM-CK9WS | HNSCC-323-TP-NB-SM-CK9WS-SM-AV34N | ARID2 | 196528 | 12 | 46240638 | 46240638 | Splice_Site | + |
| LSD6819 | LSD6819 | ARID2 | 196528 | 12 | 46243857 | 46243857 | Nonsense_Mutation | + |
| LUAD-BS-08-013532-Tumor-SM-9J2Y1 | LUAD-BS-08-013532-TP-NT-SM-9J2Y1-SM-9J2Y2 | ARID2 | 196528 | 12 | 46245525 | 46245525 | Frame_Shift_Del | + |
| LUAD-BS-13-J60666-Tumor-SM-9J2YL | LUAD-BS-13-J60666-TP-NB-SM-9J2YL-SM-9HBZW | ARID2 | 196528 | 12 | 46246071 | 46246071 | Missense_Mutation | + |
| MEL-650366-Tumor-SM-CN221 | MEL-650366-TP-NB-SM-CN221-SM-CJP7U | ARID2 | 196528 | 12 | 46245857 | 46245857 | Silent | − |
| MEL-IPI_Pat100-Tumor-SM-53U2D | MEL-IPI_Pat100-TP-NT-SM-53U2D-SM-53U4M | ARID2 | 196528 | 12 | 46230641 | 46230641 | Missense_Mutation | − |

TABLE 4-continued

Complete list of all identified SWI/SNF mutations

| Tumor_Sample_Barcode | pair_id | Hugo_Symbol | Entrez_Gene_Id | Chromo-some | Start_position | End_position | Variant_Classification | response |
|---|---|---|---|---|---|---|---|---|
| MEL-IPI_Pat100-Tumor-SM-53U2D | MEL-IPI_Pat100-TP-NT-SM-53U2D-SM-53U4M | ARID2 | 196528 | 12 | 46242701 | 46242701 | Nonsense_Mutation | − |
| MEL-IPI_Pat103-Tumor-SM-4CU6Q | MEL-IPI_Pat103-TP-NT-SM-4CU6Q-SM-53U4P | ARID2 | 196528 | 12 | 46243514 | 46243514 | Missense_Mutation | + |
| MEL-IPI_Pat109-Tumor-SM-4CU6W | MEL-IPI_Pat109-TP-NT-SM-4CU6W-SM-4MGPN | ARID2 | 196528 | 12 | 46243825 | 46243825 | Missense_Mutation | − |
| MEL-IPI_Pat109-Tumor-SM-4CU6W | MEL-IPI_Pat109-TP-NT-SM-4CU6W-SM-4MGPN | ARID2 | 196528 | 12 | 46243824 | 46243824 | Missense_Mutation | − |
| MEL-IPI_Pat115-Tumor-SM-5X2QS | MEL-IPI_Pat115-TP-NT-SM-5X2QS-SM-5X2RA | ARID2 | 196528 | 12 | 46211474 | 46211474 | Missense_Mutation | − |
| MEL-IPI_Pat117-Tumor-SM-5X2QU | MEL-IPI_Pat117-TP-NT-SM-5X2QU-SM-5X2RC | ARID2 | 196528 | 12 | 46244997 | 46244997 | Nonsense_Mutation | + |
| MEL-IPI_Pat117-Tumor-SM-5X2QU | MEL-IPI_Pat117-TP-NT-SM-5X2QU-SM-5X2RC | ARID2 | 196528 | 12 | 46245843 | 46245843 | Nonsense_Mutation | + |
| MEL-IPI_Pat132-Tumor-SM-5VWJA | MEL-IPI_Pat132-TP-NB-SM-5VWJA-SM-5VWHR | ARID2 | 196528 | 12 | 46243530 | 46243530 | Missense_Mutation | + |
| MEL-IPI_Pat138-Tumor-SM-5VWJG | MEL-IPI_Pat138-TP-NB-SM-5VWJG-SM-5VWHX | ARID2 | 196528 | 12 | 46242749 | 46242749 | Missense_Mutation | + |
| MEL-IPI_Pat139-Tumor-SM-5VWJH | MEL-IPI_Pat139-TP-NB-SM-5VWJH-SM-5VWHY | ARID2 | 196528 | 12 | 46205217 | 46205217 | Missense_Mutation | − |
| MEL-IPI_Pat151-Tumor-SM-5VWJT | MEL-IPI_Pat151-TP-NB-SM-5VWJT-SM-5VWIB | ARID2 | 196528 | 12 | 46287240 | 46287240 | Missense_Mutation | − |
| MEL-IPI_Pat159-Tumor-SM-5VWK2 | MEL-IPI_Pat159-TP-NB-SM-5VWK2-SM-5VWIJ | ARID2 | 196528 | 12 | 46244889 | 46244889 | Nonsense_Mutation | − |
| MEL-IPI_Pat174-Tumor-SM-5VOB4 | MEL-IPI_Pat174-TP-NB-SM-5VOB4-SM-5VWIY | ARID2 | 196528 | 12 | 46215271 | 46215271 | Splice_Site | + |
| MEL-IPI_Pat58-Tumor-SM-4DK2J | MEL-IPI_Pat58-TP-NB-SM-4DK2J-SM-4NFVP | ARID2 | 196528 | 12 | 46245648 | 46245648 | Missense_Mutation | − |
| MEL-IPI_Pat58-Tumor-SM-4DK2J | MEL-IPI_Pat58-TP-NB-SM-4DK2J-SM-4NFVP | ARID2 | 196528 | 12 | 46240672 | 46240672 | Missense_Mutation | − |
| MEL-IPI_Pat58-Tumor-SM-4DK2J | MEL-IPI_Pat58-TP-NB-SM-4DK2J-SM-4NFVP | ARID2 | 196528 | 12 | 46287428 | 46287428 | Missense_Mutation | − |
| MEL-IPI_Pat66-Tumor-SM-4DK2R | MEL-IPL_Pat66-TP-NB-SM-4DK2R-SM-4NFVX | ARID2 | 196528 | 12 | 46230691 | 46230691 | Missense_Mutation | + |
| PR11217 | PR11217 | ARID2 | 196528 | 12 | 46233249 | 46233249 | Nonsense_Mutation | + |
| PR11217 | PR11217 | ARID2 | 196528 | 12 | 46245639 | 46245639 | Nonsense_Mutation | + |
| PR4077 | PR4077 | ARID2 | 196528 | 12 | 46243857 | 46243857 | Nonsense_Mutation | + |
| PR4092 | PR4092 | ARID2 | 196528 | 12 | 46242619 | 46242619 | Splice_Site | + |
| Pt1 | Pt1 | ARID2 | 196528 | 12 | 46123846 | 46123846 | Missense_Mutation | − |
| Pt31 | Pt31 | ARID2 | 196528 | 12 | 46243467 | 46243467 | Missense_Mutation | − |
| Pt37 | Pt37 | ARID2 | 196528 | 12 | 46211600 | 46211600 | Frame_Shift_Del | + |
| SU2C_Lung-SU2C-DFCI-LUAD-1016-Tumor-SM-AOL8W | SU2C_Lung-SU2C-DFCI-LUAD-1016-TM-NB-SM-AOL8W-SM-A46NS | ARID2 | 196528 | 12 | 46244393 | 46244393 | Silent | ± |
| WA7899 | WA7899 | ARID2 | 196528 | 12 | 46244529 | 46244529 | Missense_Mutation | − |
| DM123062 | DM123062 | BRD7 | 29117 | 16 | 50384049 | 50384049 | Missense_Mutation | − |
| Lung-DFCI-11-104-009-Tumor-SM-5YS7O | Lung-DFCI-11-104-009-TM-NB-SM-5YS7O-SM-5YS7P | BRD7 | 29117 | 16 | 50388348 | 50388348 | Missense_Mutation | + |
| MEL-IPI_Pat03-Tumor-SM-4DJZY | MEL-IPI_Pat03-TP-NB-SM-4DJZY-SM-4NFU5 | BRD7 | 29117 | 16 | 50357497 | 50357497 | Splice_Site | − |
| MEL-IPI_Pat110-Tumor-SM-4CU6X | MEL-IPI_Pat110-TP-NT-SM-4CU6X-SM-4MGPO | BRD7 | 29117 | 16 | 50368748 | 50368748 | Missense_Mutation | − |
| MEL-IPI_Pat03-Tumor-SM-4DJZY | MEL-IPI_Pat03-TP-NB-SM-4DJZY-SM-4NFU5 | DPF1 | 8193 | 19 | 38706825 | 38706825 | Missense_Mutation | − |
| MEL-IPI_Pat132-Tumor-SM-5VWJA | MEL-IPI_Pat132-TP-NB-SM-5VWJA-SM-5VWHR | DPF1 | 8193 | 19 | 38709622 | 38709622 | Silent | + |
| MEL-IPI_Pat134-Tumor-SM-7A151 | MEL-IPI_Pat134-TP-NB-SM-7A151-SM-5VWHT | DPF1 | 8193 | 19 | 38709646 | 38709646 | Silent | − |
| MEL-IPI_Pat138-Tumor-SM-5VWJG | MEL-IPI_Pat138-TP-NB-SM-5VWJG-SM-5VWHX | DPF1 | 8193 | 19 | 38702995 | 38702995 | Silent | + |
| MEL-IPI_Pat138-Tumor-SM-5VWJG | MEL-IPI_Pat138-TP-NB-SM-5VWJG-SM-5VWHX | DPF1 | 8193 | 19 | 38704352 | 38704352 | Missense_Mutation | + |
| MEL-IPI_Pat74-Tumor-SM-4DK2Z | MEL-IPI_Pat74-TP-NB-SM-4DK2Z-SM-4NFW6 | DPF1 | 8193 | 19 | 38712998 | 38712998 | Splice_Site | − |
| Pt27 | Pt27 | DPF1 | 8193 | 19 | 38709621 | 38709621 | Missense_Mutation | + |

TABLE 4-continued

Complete list of all identified SWI/SNF mutations

| Tumor_Sample_Barcode | pair_id | Hugo_Symbol | Entrez_Gene_Id | Chromo-some | Start_position | End_position | Variant_Classification | response |
|---|---|---|---|---|---|---|---|---|
| LUAD-BS-12-R10269-Tumor-SM-9J2XO | LUAD-BS-12-R10269-TP-NB-SM-9J2XO-SM-9HBZT | DPF2 | 5977 | 11 | 65108997 | 65108997 | Silent | + |
| MEL-IPI_Pat132-Tumor-SM-5VWJA | MEL-IPI_Pat132-TP-NB-SM-5VWJA-SM-5VWHR | DPF2 | 5977 | 11 | 65107914 | 65107914 | Missense_Mutation | + |
| MEL-IPI_Pat159-Tumor-SM-5VWK2 | MEL-IPI_Pat159-TP-NB-SM-5VWK2-SM-5VWIJ | DPF2 | 5977 | 11 | 65113741 | 65113741 | Intron | − |
| MEL-IPI_Pat32-Tumor-SM-53U3T | MEL-IPI_Pat32-TP-NT-SM-53U3T-SM-53U67 | DPF2 | 5977 | 11 | 65108462 | 65108462 | Silent | − |
| MEL-IPI_Pat38-Tumor-SM-53U3Z | MEL-IPI_Pat38-TP-NT-SM-53U3Z-SM-53U5L | DPF2 | 5977 | 11 | 65123565 | 65123565 | IGR | + |
| MEL-IPI_Pat58-Tumor-SM-4DK2J | MEL-IPI_Pat58-TP-NB-SM-4DK2J-SM-4NFVP | DPF2 | 5977 | 11 | 65113530 | 65113530 | Intron | − |
| MEL-IPI_Pat74-Tumor-SM-4DK2Z | MEL-IPI_Pat74-TP-NB-SM-4DK2Z-SM-4NFW6 | DPF2 | 5977 | 11 | 65113812 | 65113812 | Intron | − |
| Pt13 | Pt13 | DPF2 | 5977 | 11 | 65111304 | 65111304 | Intron | + |
| Pt14 | Pt14 | DPF2 | 5977 | 11 | 65109007 | 65109007 | Missense_Mutation | − |
| SU2C_Lung-SU2C-DFCI-LUAD-1011-Tumor-SM-AOL75 | SU2C_Lung-SU2C-DFCI-LUAD-1011-TM-NB-SM-AOL75-SM-A46NN | DPF2 | 5977 | 11 | 65113251 | 65113251 | Intron | − |
| DFCI_MM_2-Tumor-SM-BZRJA | DFCI_MM_2-TP-NB-SM-BZRJA-SM-BZRJD | DPF3 | 8110 | 14 | 73137945 | 73137945 | Intron | + |
| DFCI_MM_2-Tumor-SM-BZRJA | DFCI_MM_2-TP-NB-SM-BZRJA-SM-BZRJD | DPF3 | 8110 | 14 | 73238507 | 73238507 | Missense_Mutation | + |
| FR9547 | FR9547 | DPF3 | 8110 | 14 | 73140993 | 73140993 | Missense_Mutation | + |
| Lung-DFCI-11-104-009-Tumor-SM-5YS7O | Lung-DFCI-11-104-009-TM-NB-SM-5YS7O-SM-5YS7P | DPF3 | 8110 | 14 | 73137964 | 73137964 | Intron | + |
| MEL-IPI_Pat110-Tumor-SM-4CU6X | MEL-IPI_Pat110-TP-NT-SM-4CU6X-SM-4MGPO | DPF3 | 8110 | 14 | 73137905 | 73137905 | Intron | − |
| MEL-IPI_Pat110-Tumor-SM-4CU6X | MEL-IPI_Pat110-TP-NT-SM-4CU6X-SM-4MGPO | DPF3 | 8110 | 14 | 73137904 | 73137904 | Intron | − |
| MEL-IPI_Pat139-Tumor-SM-5VWJH | MEL-IPI_Pat139-TP-NB-SM-5VWJH-SM-5VWHY | DPF3 | 8110 | 14 | 73138006 | 73138006 | Intron | − |
| MEL-IPI_Pat139-Tumor-SM-5VWJH | MEL-IPI_Pat139-TP-NB-SM-5VWJH-SM-5VWHY | DPF3 | 8110 | 14 | 73138005 | 73138005 | Intron | − |
| MEL-IPI_Pat16-Tumor-SM-53U3E | MEL-IPI_Pat16-TP-NT-SM-53U3E-SM-53U5B | DPF3 | 8110 | 14 | 73220050 | 73220050 | Missense_Mutation | − |
| MEL-IPI_Pat21-Tumor-SM-4DK1H | MEL-IPI_Pat21-TP-NT-SM-4DK1H-SM-53U5G | DPF3 | 8110 | 14 | 73190370 | 73190370 | Missense_Mutation | + |
| SA9755 | SA9755 | DPF3 | 8110 | 14 | 73190391 | 73190391 | Missense_Mutation | + |
| BLCA-IM07-Tumor-SM-79XDD | BLCA-IM07-TP-NB-SM-79XDD-SM-7AABP | PBRM1 | 55193 | 3 | 52621431 | 52621431 | Missense_Mutation | + |
| CR04885 | CR04885 | PBRM1 | 55193 | 3 | 52597336 | 52597336 | Missense_Mutation | + |
| M4945 | M4945 | PBRM1 | 55193 | 3 | 52696148 | 52696148 | Splice_Site | + |
| MA7027 | MA7027 | PBRM1 | 55193 | 3 | 52598231 | 52598231 | Missense_Mutation | − |
| MEL-IPI_Pat103-Tumor-SM-4CU6Q | MEL-IPI_Pat103-TP-NT-SM-4CU6Q-SM-53U4P | PBRM1 | 55193 | 3 | 52620592 | 52620592 | Missense_Mutation | + |
| MEL-IPI_Pat103-Tumor-SM-4CU6Q | MEL-IPI_Pat103-TP-NT-SM-4CU6Q-SM-53U4P | PBRM1 | 55193 | 3 | 52620593 | 52620593 | Missense_Mutation | + |
| MEL-IPI_Pat118-Tumor-SM-5X2QV | MEL-IPI_Pat118-TP-NT-SM-5X2QV-SM-5X2RD | PBRM1 | 55193 | 3 | 52692325 | 52692325 | Missense_Mutation | − |
| MEL-IPI_Pat138-Tumor-SM-5VWJG | MEL-IPI_Pat138-TP-NB-SM-5VWJG-SM-5VWHX | PBRM1 | 55193 | 3 | 52595959 | 52595959 | Missense_Mutation | + |
| MEL-IPI_Pat151-Tumor-SM-5VWJT | MEL-IPI_Pat151-TP-NB-SM-5VWJT-SM-5VWIB | PBRM1 | 55193 | 3 | 52643530 | 52643530 | Missense_Mutation | − |
| MEL-IPI_Pat38-Tumor-SM-53U3Z | MEL-IPI_Pat38-TP-NT-SM-53U3Z-SM-53U5L | PBRM1 | 55193 | 3 | 52643692 | 52643692 | Missense_Mutation | + |
| MEL-IPI_Pat70-Tumor-SM-4DK2V | MEL-IPI_Pat70-TP-NB-SM-4DK2V-SM-4NFW2 | PBRM1 | 55193 | 3 | 52584527 | 52584527 | Missense_Mutation | − |
| MEL-IPI_Pat79-Tumor-SM-53U2S | MEL-IPI_Pat79-TP-NB-SM-53U2S-SM-4NFWB | PBRM1 | 55193 | 3 | 52621315 | 52621315 | Intron | + |
| MEL-IPI_Pat88-Tumor-SM-4DK3E | MEL-IPI_Pat88-TP-NT-SM-4DK3E-SM-53U4C | PBRM1 | 55193 | 3 | 52668815 | 52668815 | Silent | + |
| MEL-IPI_Pat88-Tumor-SM-4DK3E | MEL-IPI_Pat88-TP-NT-SM-4DK3E-SM-53U4C | PBRM1 | 55193 | 3 | 52668765 | 52668765 | Missense_Mutation | + |
| PR4035 | PR4035 | PBRM1 | 55193 | 3 | 52643768 | 52643768 | Nonsense_Mutation | + |
| Pt13 | Pt13 | PBRM1 | 55193 | 3 | 52643768 | 52643768 | Nonsense_Mutation | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| SU2C_Lung-SU2C-DFCI-LUAD-1017-Tumor-SM-AOL99 | SU2C_Lung-SU2C-DFCI-LUAD-1017-TM-NB-SM-AOL99-SM-A46NT | PBRM1 | 55193 | 3 | 52651406 | 52651406 | Nonsense_Mutation | + |
| MEL-IPI_Pat110-Tumor-SM-4CU6X | MEL-IPI_Pat110-TP-NT-SM-4CU6X-SM-4MGPO | PHF10 | 55274 | 6 | 170112483 | 170112483 | Splice_Site | − |
| MEL-IPI_Pat138-Tumor-SM-5VWJG | MEL-IPI_Pat138-TP-NB-SM-5VWJG-SM-5VWHX | PHF10 | 55274 | 6 | 170116103 | 170116103 | Missense_Mutation | + |
| MEL-IPI_Pat58-Tumor-SM-4DK2J | MEL-IPI_Pat58-TP-NB-SM-4DK2J-SM-4NFVP | PHF10 | 55274 | 6 | 170117919 | 170117919 | Splice_Site | − |
| Pt1 | Pt1 | PHF10 | 55274 | 6 | 170112579 | 170112579 | Missense_Mutation | − |
| Pt2 | Pt2 | PHF10 | 55274 | 6 | 170116131 | 170116131 | Missense_Mutation | + |
| SD1494 | SD1494 | PHF10 | 55274 | 6 | 170117924 | 170117924 | Missense_Mutation | ± |
| BLCA-IM10-Tumor-SM-79XDG | BLCA-IM10-TP-NB-SM-79XDG-SM-9QSPX | SMARCA2 | 6595 | 9 | 2181573 | 2181573 | Missense_Mutation | + |
| BLCA-IM11-Tumor-SM-79XDH | BLCA-IM11-TP-NT-SM-79XDH-SM-79XDI | SMARCA2 | 6595 | 9 | 2033008 | 2033008 | Missense_Mutation | + |
| LSD0167 | LSD0167 | SMARCA2 | 6595 | 9 | 2161819 | 2161819 | Missense_Mutation | + |
| MEL-IPI_Pat132-Tumor-SM-5VWJA | MEL-IPI_Pat132-TP-NB-SM-5VWJA-SM-5VWHR | SMARCA2 | 6595 | 9 | 2039901 | 2039901 | Splice_Site | + |
| MEL-IPI_Pat132-Tumor-SM-5VWJA | MEL-IPI_Pat132-TP-NB-SM-5VWJA-SM-5VWHR | SMARCA2 | 6595 | 9 | 2186134 | 2186134 | Silent | + |
| MEL-IPI_Pat138-Tumor-SM-5VWJG | MEL-IPI_Pat138-TP-NB-SM-5VWJG-SM-5VWHX | SMARCA2 | 6595 | 9 | 2056722 | 2056722 | Silent | + |
| MEL-IPI_Pat15-Tumor-SM-4DK1B | MEL-IPI_Pat15-TP-NB-SM-4DK1B-SM-4NFUH | SMARCA2 | 6595 | 9 | 2070473 | 2070473 | Splice_Site | − |
| MEL-IPI_Pat21-Tumor-SM-4DK1H | MEL-IPI_Pat21-TP-NT-SM-4DK1H-SM-53U5G | SMARCA2 | 6595 | 9 | 2161845 | 2161845 | Missense_Mutation | + |
| MEL-IPI_Pat38-Tumor-SM-53U3Z | MEL-IPI_Pat38-TP-NT-SM-53U3Z-SM-53U5L | SMARCA2 | 6595 | 9 | 2039623 | 2039623 | Silent | + |
| MEL-IPI_Pat90-Tumor-SM-4DK3G | MEL-IPI_Pat90-TP-NB-SM-4DK3G-SM-4NFWM | SMARCA2 | 6595 | 9 | 2186142 | 2186142 | Missense_Mutation | + |
| PR4092 | PR4092 | SMARCA2 | 6595 | 9 | 2161836 | 2161836 | Missense_Mutation | + |
| Pt31 | Pt31 | SMARCA2 | 6595 | 9 | 2104046 | 2104046 | Missense_Mutation | − |
| RH090935 | RH090935 | SMARCA2 | 6595 | 9 | 2123911 | 2123911 | Missense_Mutation | + |
| SD2056 | SD2056 | SMARCA2 | 6595 | 9 | 2077654 | 2077654 | Missense_Mutation | + |
| Y2087 | Y2087 | SMARCA2 | 6595 | 9 | 2047355 | 2047355 | Missense_Mutation | ± |
| BLCA-IM07-Tumor-SM-79XDD | BLCA-IM07-TP-NB-SM-79XDD-SM-7AABP | SMARCA4 | 6597 | 19 | 11134267 | 11134267 | Missense_Mutation | + |
| BLCA-IM09-Tumor-SM-79XDF | BLCA-IM09-TP-NB-SM-79XDF-SM-7AABN | SMARCA4 | 6597 | 19 | 11097617 | 11097617 | Missense_Mutation | + |
| FR9547 | FR9547 | SMARCA4 | 6597 | 19 | 11136975 | 11136975 | Splice_Site | + |
| HNSCC-186-Tumor-SM-AXGDN | HNSCC-186-TP-NB-SM-AXGDN-SM-ADP7L | SMARCA4 | 6597 | 19 | 11144853 | 11144853 | 3'UTR | + |
| HNSCC-186-Tumor-SM-AXGDN | HNSCC-186-TP-NB-SM-AXGDN-SM-ADP7L | SMARCA4 | 6597 | 19 | 11144853 | 11144853 | 3'UTR | + |
| HNSCC-258-Tumor-SM-AXGAI | HNSCC-258-TP-NB-SM-AXGAI-SM-ADP7G | SMARCA4 | 6597 | 19 | 11170556 | 11170556 | Missense_Mutation | + |
| HNSCC-323-Tumor-SM-CK9WS | HNSCC-323-TP-NB-SM-CK9WS-SM-AV34N | SMARCA4 | 6597 | 19 | 11096069 | 11096069 | Nonsense_Mutation | + |
| LUAD-BS-13-J60666-Tumor-SM-9J2YL | LUAD-BS-13-J60666-TP-NB-SM-9J2YL-SM-9HBZW | SMARCA4 | 6597 | 19 | 11132428 | 11132428 | Missense_Mutation | + |
| LUAD-BS-14-G65174-Tumor-SM-9J2YF | LUAD-BS-14-G65174-TP-NT-SM-9J2YF-SM-9J2YG | SMARCA4 | 6597 | 19 | 11145805 | 11145805 | 3'UTR | − |
| M4945 | M4945 | SMARCA4 | 6597 | 19 | 11144072 | 11144072 | IGR | + |
| MA7027 | MA7027 | SMARCA4 | 6597 | 19 | 11134207 | 11134207 | Missense_Mutation | − |
| MEL-IPI_Pat08-Tumor-SM-4DK14 | MEL-IPI_Pat08-TP-NB-SM-4DK14-SM-4NFUA | SMARCA4 | 6597 | 19 | 11121151 | 11121151 | Missense_Mutation | − |
| MEL-IPI_Pat110-Tumor-SM-4CU6X | MEL-IPI_Pat110-TP-NT-SM-4CU6X-SM-4MGPO | SMARCA4 | 6597 | 19 | 11096986 | 11096986 | Silent | − |
| MEL-IPI_Pat110-Tumor-SM-4CU6X | MEL-IPI_Pat110-TP-NT-SM-4CU6X-SM-4MGPO | SMARCA4 | 6597 | 19 | 11134230 | 11134230 | Missense_Mutation | − |
| MEL-IPI_Pat132-Tumor-SM-5VWJA | MEL-IPI_Pat132-TP-NB-SM-5VWJA-SM-5VWHR | SMARCA4 | 6597 | 19 | 11144106 | 11144106 | IGR | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat138-Tumor-SM-5VWJG | MEL-IPI_Pat138-TP-NB-SM-5VWJG-SM-5VWHX | SMARCA4 | 6597 | 19 | 11144028 | 11144028 | IGR | + |
| MEL-IPI_Pat139-Tumor-SM-5VWJH | MEL-IPI_Pat139-TP-NB-SM-5VWJH-SM-5VWHY | SMARCA4 | 6597 | 19 | 11136986 | 11136986 | Missense_Mutation | − |
| MEL-IPI_Pat16-Tumor-SM-53U3E | MEL-IPI_Pat16-TP-NT-SM-53U3E-SM-53U5B | SMARCA4 | 6597 | 19 | 11141561 | 11141561 | IGR | − |
| MEL-IPI_Pat19-Tumor-SM-4DK1F | MEL-IPI_Pat19-TP-NB-SM-4DK1F-SM-4NFUL | SMARCA4 | 6597 | 19 | 11144856 | 11144856 | 3'UTR | − |
| MEL-IPI_Pat28-Tumor-SM-4DK1O | MEL-IPI_Pat28-TP-NB-SM-4DK1O-SM-4NFUU | SMARCA4 | 6597 | 19 | 11137018 | 11137018 | Nonsense_Mutation | − |
| MEL-IPI_Pat49-Tumor-SM-4DK2A | MEL-IPI_Pat49-TP-NT-SM-4DK2A-SM-53U5W | SMARCA4 | 6597 | 19 | 11121110 | 11121110 | Missense_Mutation | ± |
| MEL-IPI_Pat52-Tumor-SM-4DK2D | MEL-IPI_Pat52-TP-NT-SM-4DK2D-SM-53U5Z | SMARCA4 | 6597 | 19 | 11097614 | 11097614 | Missense_Mutation | − |
| MEL-IPI_Pat54-Tumor-SM-4DK2F | MEL-IPI_Pat54-TP-NB-SM-4DK2F-SM-4NFVL | SMARCA4 | 6597 | 19 | 11100047 | 11100047 | Silent | − |
| MEL-IPI_Pat58-Tumor-SM-4DK2J | MEL-IPI_Pat58-TP-NB-SM-4DK2J-SM-4NFVP | SMARCA4 | 6597 | 19 | 11098595 | 11098595 | Silent | − |
| Pt31 | Pt31 | SMARCA4 | 6597 | 19 | 11170804 | 11170804 | Nonsense_Mutation | − |
| SA9755 | SA9755 | SMARCA4 | 6597 | 19 | 11123685 | 11123685 | Missense_Mutation | + |
| SD1494 | SD1494 | SMARCA4 | 6597 | 19 | 11118614 | 11118614 | Missense_Mutation | ± |
| HNSCC-181-Tumor-SM-CK9X1 | HNSCC-181-TP-NB-SM-CK9X1-SM-AV34P | SMARCB1 | 6598 | 22 | 24129440 | 24129440 | Silent | − |
| MEL-IPI_Pat110-Tumor-SM-4CU6X | MEL-IPI_Pat110-TP-NT-SM-4CU6X-SM-4MGPO | SMARCB1 | 6598 | 22 | 24143148 | 24143148 | Intron | − |
| MEL-IPI_Pat110-Tumor-SM-4CU6X | MEL-IPI_Pat110-TP-NT-SM-4CU6X-SM-4MGPO | SMARCB1 | 6598 | 22 | 24143149 | 24143149 | Intron | − |
| MEL-IPI_Pat130-Tumor-SM-5X2R8 | MEL-IPI_Pat130-TP-NT-SM-5X2R8-SM-5X2RJ | SMARCB1 | 6598 | 22 | 24143281 | 24143281 | Intron | − |
| MEL-IPI_Pat62-Tumor-SM-4DK2N | MEL-IPI_Pat62-TP-NB-SM-4DK2N-SM-4NFVT | SMARCB1 | 6598 | 22 | 24145537 | 24145537 | Silent | − |
| Pt2 | Pt2 | SMARCB1 | 6598 | 22 | 24133958 | 24133958 | Missense_Mutation | + |
| Lung-DFCI-11-104-009-Tumor-SM-5YS7O | Lung-DFCI-11-104-009-TM-NB-SM-5YS7O-SM-5YS7P | SMARCC1 | 6599 | 3 | 47823230 | 47823230 | Missense_Mutation | + |
| MEL-IPI_Pat03-Tumor-SM-4DJZY | MEL-IPI_Pat03-TP-NB-SM-4DJZY-SM-4NFU5 | SMARCC1 | 6599 | 3 | 47680267 | 47680267 | Missense_Mutation | − |
| MEL-IPI_Pat03-Tumor-SM-4DJZY | MEL-IPI_Pat03-TP-NB-SM-4DJZY-SM-4NFU5 | SMARCC1 | 6599 | 3 | 47787455 | 47787455 | Missense_Mutation | − |
| MEL-IPI_Pat08-Tumor-SM-4DK14 | MEL-IPI_Pat08-TP-NB-SM-4DK14-SM-4NFUA | SMARCC1 | 6599 | 3 | 47777539 | 47777539 | Silent | − |
| MEL-IPI_Pat110-Tumor-SM-4CU6X | MEL-IPI_Pat110-TP-NT-SM-4CU6X-SM-4MGPO | SMARCC1 | 6599 | 3 | 47632172 | 47632172 | Silent | − |
| MEL-IPI_Pat151-Tumor-SM-5VWJT | MEL-IPI_Pat151-TP-NB-SM-5VWJT-SM-5VWIB | SMARCC1 | 6599 | 3 | 47787430 | 47787430 | Silent | − |
| MEL-IPI_Pat28-Tumor-SM-4DK1O | MEL-IPI_Pat28-TP-NB-SM-4DK1O-SM-4NFUU | SMARCC1 | 6599 | 3 | 47742863 | 47742863 | Missense_Mutation | − |
| MEL-IPI_Pat58-Tumor-SM-4DK2J | MEL-IPI_Pat58-TP-NB-SM-4DK2J-SM-4NFVP | SMARCC1 | 6599 | 3 | 47651680 | 47651680 | Silent | − |
| MEL-IPI_Pat58-Tumor-SM-4DK2J | MEL-IPI_Pat58-TP-NB-SM-4DK2J-SM-4NFVP | SMARCC1 | 6599 | 3 | 47770567 | 47770567 | Silent | − |
| Pt4 | Pt4 | SMARCC1 | 6599 | 3 | 47629788 | 47629788 | Missense_Mutation | + |
| CR04885 | CR04885 | SMARCC2 | 6601 | 12 | 56565627 | 56565627 | Missense_Mutation | + |
| MEL-IPI_Pat138-Tumor-SM-5VWJG | MEL-IPI_Pat138-TP-NB-SM-5VWJG-SM-5VWHX | SMARCC2 | 6601 | 12 | 56558459 | 56558459 | Missense_Mutation | + |
| MEL-IPI_Pat139-Tumor-SM-5VWJH | MEL-IPI_Pat139-TP-NB-SM-5VWJH-SM-5VWHY | SMARCC2 | 6601 | 12 | 56558475 | 56558475 | Missense_Mutation | − |
| MEL-IPI_Pat27-Tumor-SM-4DK1N | MEL-IPI_Pat27-TP-NB-SM-4DK1N-SM-4NFUT | SMARCC2 | 6601 | 12 | 56578857 | 56578857 | Missense_Mutation | − |
| MEL-IPI_Pat32-Tumor-SM-53U3T | MEL-IPI_Pat32-TP-NT-SM-53U3T-SM-53U67 | SMARCC2 | 6601 | 12 | 56572223 | 56572223 | Silent | − |
| MEL-IPI_Pat58-Tumor-SM-4DK2J | MEL-IPI_Pat58-TP-NB-SM-4DK2J-SM-4NFVP | SMARCC2 | 6601 | 12 | 56563668 | 56563668 | Missense_Mutation | − |
| MEL-IPI_Pat64-Tumor-SM-4DK2P | MEL-IPI_Pat64-TP-NB-SM-4DK2P-SM-4NFVV | SMARCC2 | 6601 | 12 | 56563227 | 56563230 | Intron | − |
| MEL-IPI_Pat71-Tumor-SM-4DK2W | MEL-IPI_Pat71-TP-NB-SM-4DK2W-SM-4NFW3 | SMARCC2 | 6601 | 12 | 56566475 | 56566475 | Missense_Mutation | − |
| MEL-IPI_Pat77-Tumor-SM-4DK33 | MEL-IPI_Pat77-TP-NT-SM-4DK33-SM-53U63 | SMARCC2 | 6601 | 12 | 56575309 | 56575309 | Missense_Mutation | + |

TABLE 4-continued

Complete list of all identified SWI/SNF mutations

| Tumor_Sample_Barcode | pair_id | Hugo_Symbol | Entrez_Gene_Id | Chromosome | Start_position | End_position | Variant_Classification | response |
|---|---|---|---|---|---|---|---|---|
| MEL-IPI_Pat77-Tumor-SM-4DK33 | MEL-IPI_Pat77-TP-NT-SM-4DK33-SM-53U63 | SMARCC2 | 6601 | 12 | 56575308 | 56575308 | Missense_Mutation | + |
| MEL-IPI_Pat62-Tumor-SM-4DK2N | MEL-IPI_Pat62-TP-NB-SM-4DK2N-SM-4NFVT | SMARCD1 | 6602 | 12 | 50480624 | 50480624 | Missense_Mutation | − |
| Pt37 | Pt37 | SMARCD1 | 6602 | 12 | 50484135 | 50484135 | Nonsense_Mutation | + |
| LUAD-BS-13-J60666-Tumor-SM-9J2YL | LUAD-BS-13-J60666-TP-NB-SM-9J2YL-SM-9HBZW | SMARCD2 | 6603 | 17 | 61912836 | 61912836 | Missense_Mutation | + |
| MEL-IPI_Pat119-Tumor-SM-7459N | MEL-IPI_Pat119-TP-NT-SM-7459N-SM-7459Q | SMARCD2 | 6603 | 17 | 61914856 | 61914856 | Nonsense_Mutation | − |
| MEL-IPI_Pat119-Tumor-SM-7459N | MEL-IPI_Pat119-TP-NT-SM-7459N-SM-7459Q | SMARCD2 | 6603 | 17 | 61914857 | 61914857 | Silent | − |
| MEL-IPI_Pat151-Tumor-SM-5VWJT | MEL-IPI_Pat151-TP-NB-SM-5VWJT-SM-5VWIB | SMARCD2 | 6603 | 17 | 61912922 | 61912922 | Silent | − |
| MEL-IPI_Pat21-Tumor-SM-4DK1H | MEL-IPI_Pat21-TP-NT-SM-4DK1H-SM-53U5G | SMARCD2 | 6603 | 17 | 61911039 | 61911039 | Missense_Mutation | + |
| MEL-IPI_Pat38-Tumor-SM-53U3Z | MEL-IPI_Pat38-TP-NT-SM-53U3Z-SM-53U5L | SMARCD2 | 6603 | 17 | 61914827 | 61914827 | Silent | + |
| Case3-BaselineTumor | Case3-TP-NB-Zaretsky | SMARCD3 | 6604 | 7 | 150939235 | 150939235 | Silent | + |
| MEL-IPI_Pat11-Tumor-SM-4DK17 | MEL-IPI_Pat11-TP-NB-SM-4DK17-SM-4NFUD | SMARCD3 | 6604 | 7 | 150939045 | 150939045 | Missense_Mutation | − |
| BLADDER-15330_CCPM_0700694-Tumor-SM-AVI16 | BLADDER-15330_CCPM_0700694-TM-NB-SM-AVI16-SM-AVHZK | SMARCE1 | 6605 | 17 | 38793628 | 38793632 | Intron | + |
| MEL-IPI_Pat123-Tumor-SM-5X2R1 | MEL-IPI_Pat123-TP-NB-SM-5X2R1-SM-5VWHL | SMARCE1 | 6605 | 17 | 38787856 | 38787856 | Silent | + |
| MEL-IPI_Pat132-Tumor-SM-5VWJA | MEL-IPI_Pat132-TP-NB-SM-5VWJA-SM-5VWHR | SMARCE1 | 6605 | 17 | 38788513 | 38788513 | Silent | + |
| MEL-IPI_Pat138-Tumor-SM-5VWJG | MEL-IPI_Pat138-TP-NB-SM-5VWJG-SM-5VWHX | SMARCE1 | 6605 | 17 | 38787103 | 38787103 | Missense_Mutation | + |
| MEL-IPI_Pat138-Tumor-SM-5VWJG | MEL-IPI_Pat138-TP-NB-SM-5VWJG-SM-5VWHX | SMARCE1 | 6605 | 17 | 38785098 | 38785098 | Missense_Mutation | + |
| MEL-IPI_Pat70-Tumor-SM-4DK2V | MEL-IPI_Pat70-TP-NB-SM-4DK2V-SM-4NFW2 | SMARCE1 | 6605 | 17 | 38792665 | 38792665 | Silent | − |

All samples in Table 4 were from broad.mit.edu with NCBI-build no. of 37 and can be further identified based on the following information: ##Oncotator v1.2.7.0 Flat File Reference hg19|GENCODE v19|UnProt_AAxform 2011_09|ClinVar 12.03.20|ESP 6500SI-V2|ORegAnno UCSC Track|dbSNP build 134|CCLE_By_GP 09292010|COSMIC v62_291112|1000Genome phase1|UniProt_AA 2011_09|dbNSFP v2.4|ESP 6500SI-V2|COSMIC_FusionGenes v62_291112|gencode_xref_refseq metadata v19|CCLE_By_Gene 09292010|ACHILLES_Lineage_Results 110303|CGC full_2012-03-15|UniProt 2011_09|HumanDNARepairGenes 20110905|HGNC Nov2013|COSMIC_Tissue 291112|Familial_Cancer_Genes 20110905|TUMORScape 20100104|Ensembl ICGC MUCOPA|TCGAScape 110405|MutSig Published Results 20110905.

For responses, "+" represents having clinical benefit; "±" represents having intermediate benefit; and "−" represents having no clinical benefit.

TABLE 5

| Hugo_Symbol | n_cb_truncating | n_ncb_truncating | n_truncating | n_cb_nonsyn | n_ncb_nonsyn | n_nonsyn |
|---|---|---|---|---|---|---|
| ARID1A | 3 | 6 | 11 | 9 | 14 | 27 |
| SMARCE1 | 0 | 0 | 0 | 2 | 0 | 2 |
| ARID1B | 0 | 0 | 0 | 11 | 3 | 17 |
| SMARCA4 | 2 | 2 | 4 | 7 | 7 | 16 |
| PBRM1 | 4 | 0 | 4 | 11 | 4 | 15 |
| SMARCA2 | 1 | 1 | 2 | 9 | 2 | 12 |
| ARID2 | 12 | 2 | 14 | 18 | 14 | 32 |
| SMARCD3 | 0 | 0 | 0 | 0 | 1 | 1 |
| ACTL6B | 0 | 1 | 2 | 6 | 3 | 10 |
| SMARCC2 | 0 | 0 | 0 | 4 | 4 | 8 |
| DPF3 | 0 | 0 | 0 | 4 | 1 | 5 |
| BRD7 | 0 | 1 | 1 | 1 | 3 | 4 |
| SMARCB1 | 0 | 0 | 0 | 1 | 0 | 1 |
| DPF2 | 0 | 0 | 0 | 1 | 1 | 2 |
| SMARCD2 | 0 | 1 | 1 | 2 | 1 | 3 |
| SMARCC1 | 0 | 0 | 0 | 2 | 3 | 5 |
| DPF1 | 0 | 1 | 1 | 2 | 2 | 4 |

TABLE 5-continued

| Hugo_Symbol | n_cb_truncating | n_ncb_truncating | n_truncating | n_cb_nonsyn | n_ncb_nonsyn | n_nonsyn |
|---|---|---|---|---|---|---|
| PHF10 | 0 | 2 | 2 | 2 | 3 | 6 |
| ACTL6A | 0 | 0 | 0 | 2 | 1 | 3 |
| SMARCD1 | 1 | 0 | 1 | 1 | 1 | 2 |

All samples in Table 5 were taken from 98 patients with clinical benefit and 132 patients with no clinical benefit from immune checkpoint therapy "n_cb_truncating" refers to the total number of patients with truncating mutation in a given gene with clinical benefit from immune checkpoint therapy; "n_ncb_truncating" refers to the total number of patients with truncating mutation in a given gene with no clinical benefit from immune checkpoint therapy; "n truncating" refers to the total number of truncating mutations in a given gene in the cohort (includes patients with intermediate clinical benefit); "n_cb_nonsyn" refers to the total number of patients with nonsynonymous mutation in a given gene with clinical benefit from immune checkpoint therapy; "n_ncb_nonsyn" refers to the total number of patients with nonsynonymous mutation in a given gene with no clinical benefit from immune checkpoint therapy; and "n_nonsyn" refers to the total number of nonsynonymous mutations in a given gene in the cohort (includes patients with intermediate clinical benefit).

Figure 10:
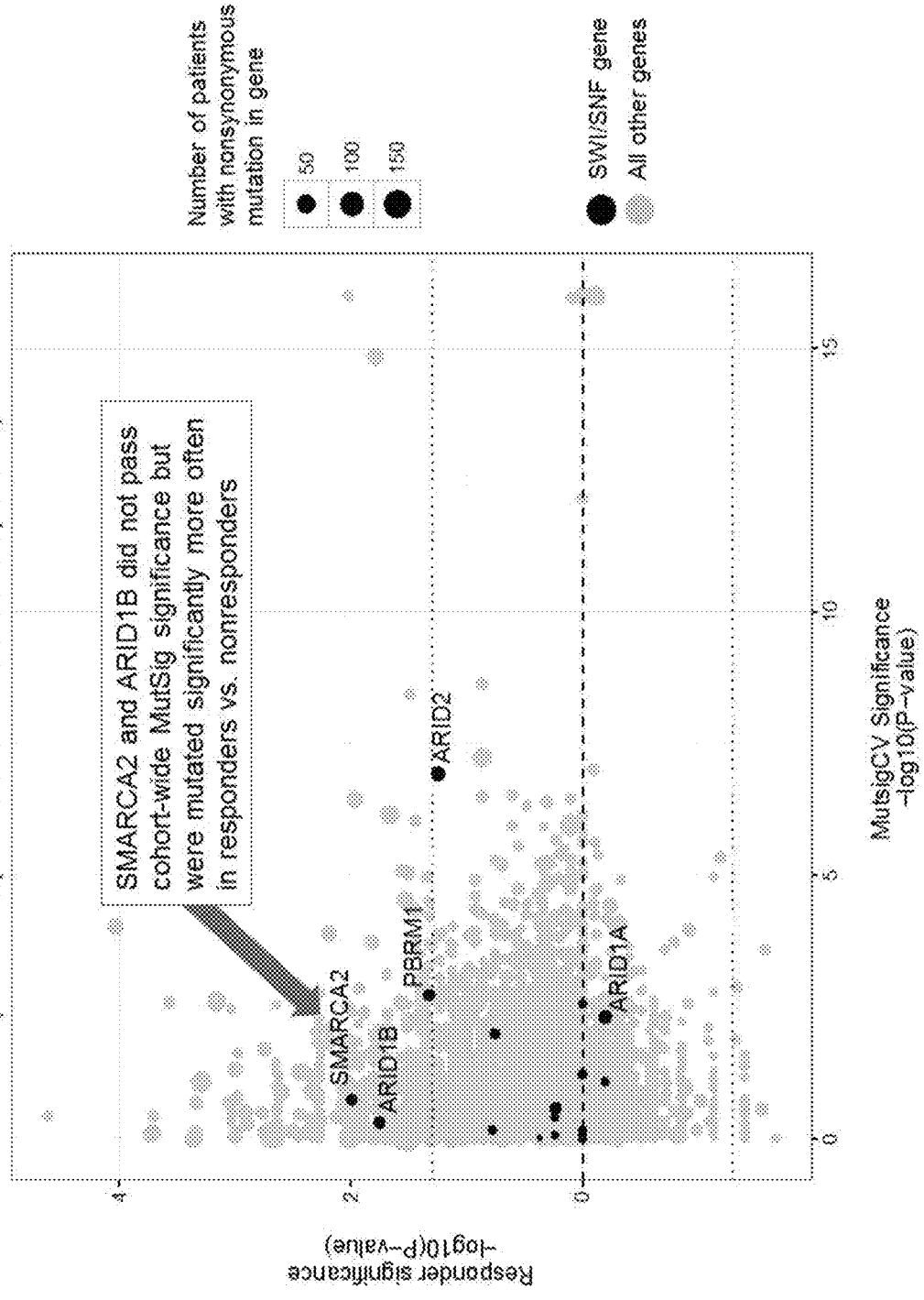
FIG. 10 shows SWI/SNF-relevant genes significantly mutated in responders vs. non-responders.

A summary of SWI/SNF complex is illustrated in FIG. 9. ARID2 and PBRM1 are two representative genes in the SWI/SNF complex, which were found in this study as relevant to sensitivity to immunotherapies such as those antagonizing immune checkpoints. SMARCA2 (also known as BRM) and ARID1B did not pass cohort-wide MutSig significance, but were mutated significantly more often in responders vs. non-responders (FIG. 10).

Alterations in PBRM1 are a common driver in clear-cell renal cell carcinoma (up to 40%), where it has a tumor suppressor function, but are rarer in other cancer types. This cohort contained 14 patients (8.3%) with nonsynonymous mutations in PBRM1 and 4 patients (1.5%, 2 with melanoma and 2 with non-small-cell lung cancer) with truncating alterations.

Figure 11:
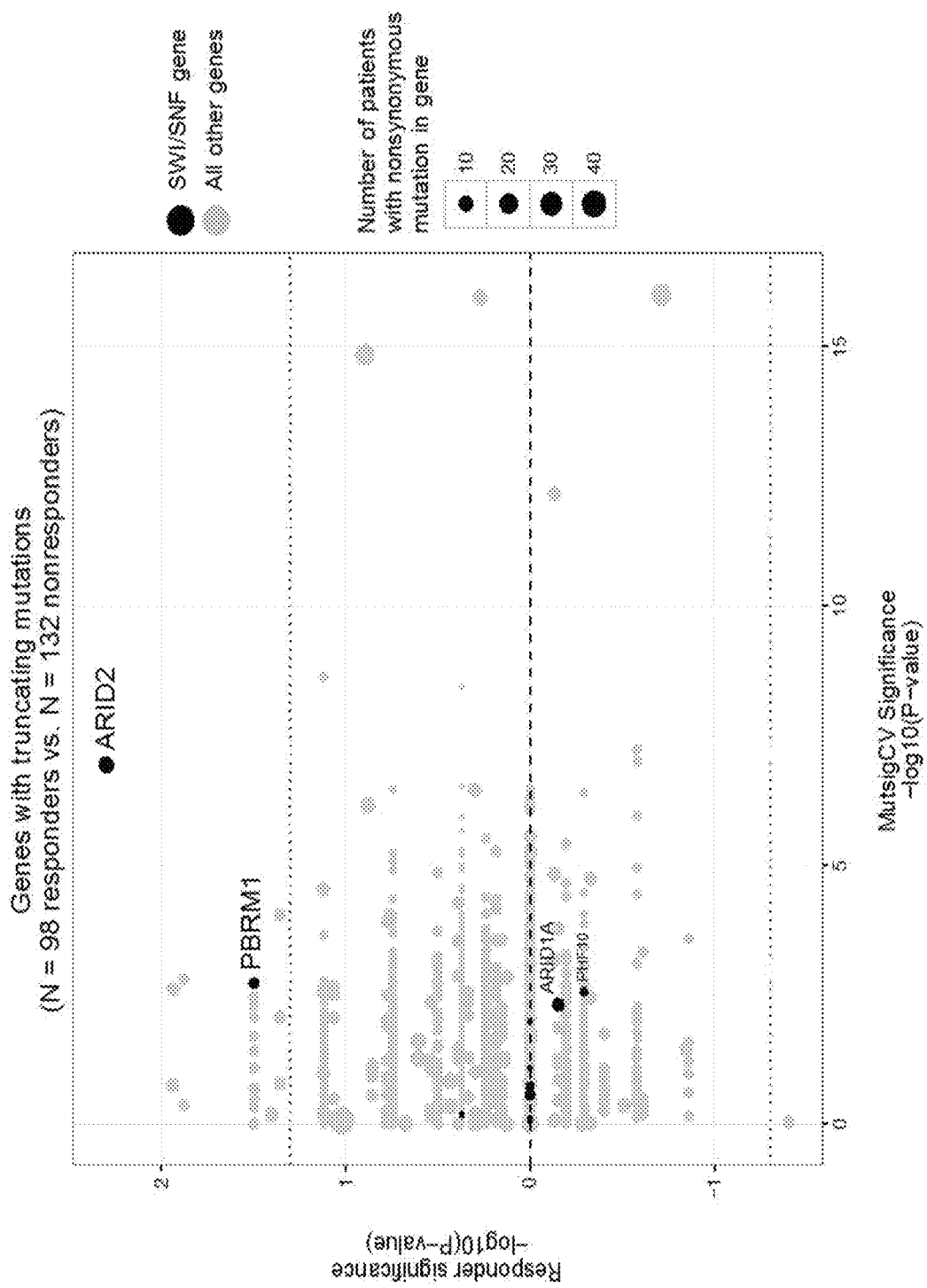
FIG. 11 shows SWI/SNF-relevant genes significantly mutated (such as those having truncating mutations) in responders vs. non-responders.

Similarly, ARID2 is a common driver mutation in hepatocellular carcinoma and melanoma. This cohort contained 26 patients (15.4%) with nonsynonymous mutations in ARID2 and 12 (7.1%, 10 with melanoma, 1 with head and neck squamous cell carcinoma, and 1 with non-small-cell lung cancer) with truncating alterations. Truncating (but not nonsynonymous) mutations in ARID2 were significantly associated with clinical benefit vs. no clinical benefit after controlling for nonsynonymous mutational load (p=0.0051; logistic regression) (FIG. 11). Nonsynonymous alterations in PBRM1 were marginally associated with clinical benefit (p=0.058) after controlling for mutational burden, while truncating mutations were not (p=0.98), perhaps due to the relative rarity of these events.

Figure 12:
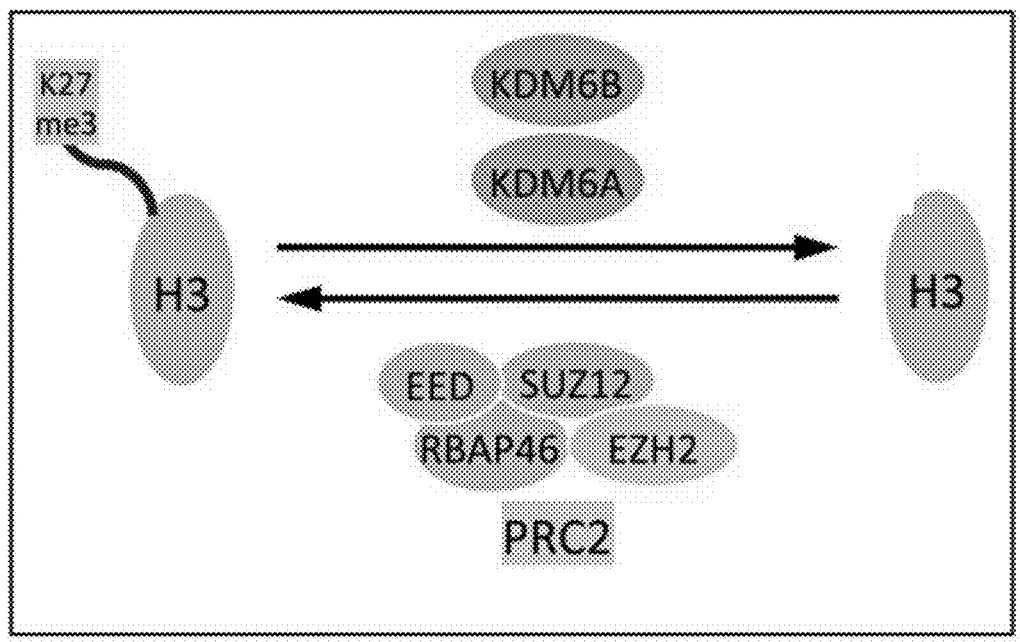
FIG. 12 depicts an enzymatic function scheme of KDM6A.

KDM6A encodes an enzyme called lysine-specific demethylase 6A that functions as a histone demethylase (FIG. 12). Truncating alterations in KDM6A were seen in 8 patients (4.8%, 5 with bladder cancer and 3 with melanoma) in this cohort. Truncating (but not nonsynonymous) alterations in KDM6A were marginally associated with clinical benefit (p=0.089; logistic regression) after controlling for mutational burden.

Immune checkpoint therapies can yield durable responses and long-lasting survival benefit across many cancer types, and checkpoint therapies have been approved for use in metastatic melanoma, non-small cell lung cancer, bladder cancer, and renal cell carcinoma, including as a first-line therapy for lung cancer. While past studies have highlighted mutational load, neoantigen presentation, transcriptomic signatures, microbiome features, and immune cell infiltration as correlated with response to immune checkpoint therapies in melanoma, non-small-cell lung cancer, and bladder cancer, the results described herein indicate that nonsynonymous alterations in the SWI/SNF chromatin remodeling complex has predictive value for patient response to immune checkpoint therapies. Moreover, other biomarkers described herein, such as additional chromatin modifying genes like KDM6A and EGFR (resistance) biomarkers, were identified. In particular, EGFR showed a strong trend with intrinsic resistance to immune checkpoint therapy in lung cancer (FIG. 6). In addition, as described further in Example 4 below, cancers with hotspot mutations in EGFR are significantly less likely to respond to immune checkpoint therapies.

Thus, these results are believed to have wide-ranging implications for patient stratification for immune checkpoint therapies and those treated with other therapies, such as EGFR signaling inhibitors. Additionally, this finding drew from the largest set of clinically annotated cancer types yet collected (>200 pre-treatment patient tumors) across both well-studied and more poorly understood cancer types, lending great statistical power to detect associations. Finally, these results provide biomarkers, drug design, and combination treatment strategies across cancer types.

Example 3: Meta-Analysis of Genomic Predictors of Response to Immune Checkpoint Therapy in Metastatic Melanoma Since immune checkpoint therapies only benefit a subset of patients with metastatic melanoma and the ability to predict clinical outcomes is limited, a meta-analysis of genomic predictors of outcomes to anti-PD1 blockade and anti-CTLA4 blockade in melanoma combining 220 sequenced tumors from 3 published cohorts was conducted in order to validate existing hypotheses regarding response to immune checkpoint therapies and discover new relationships with greater power.

Nonsynonymous mutational burden was significantly higher in clinical benefit (CB) vs. no clinical benefit (NCB) using all 3 response metrics, though the significance was less pronounced when using PFS alone (p<0.01 vs. p<0.0001; Wilcoxon rank sum), partially due to 3 patients with high mutational burden who experienced PR lasting <6 months, potentially representing early acquired rather than intrinsic resistance. In order to assess the impact of mutational processes contributing to overall mutational burden, a non-negative matrix factorization framework was used to infer mutational activity in tumors from 6 signatures previously seen in melanoma: aging (S1), T>C substitutions (S5), UV (S7), mismatch repair (S6), alkylating agents (S11), and T>G substitutions (S17). Across all samples, the proportion of mutations in S7 or S11 was positively correlated with mutational burden (Spearman's rho=0.66), while S5 and S1 were anti-correlated (rho=−0.62). Additionally, in a multivariate logistic model, S7 and S11 activity were independent predictors of clinical benefit adjusting for mutational load (p<0.05), with the sum of S7 and S11 activity being a strong predictor (p<0.001). Of the patients with low mutational burden (<median) with CB, 79% had >1/2 of mutations in S7 or S11, compared to only 51% of NCB (p<0.01; Pearson's chi-squared). Neoantigen burden was strongly correlated with mutational burden, and did not improve ability to predict CB. In examining mutations in specific genes, >500 genes were mutated significantly more frequently in CB or NCB (p<0.05, Fisher's exact). Restricting analysis to recurrently mutated genes in cancer and correcting for patient mutational burden by permutation, nonsynonymous mutations in ACSL3 and MET and truncating alterations in ARID2 were significantly enriched in CB.

In this meta-analysis of 220 patients, harmonized clinical and whole exome analysis confirmed that mutational burden correlates with CB from anti-PD1 and anti-CTLA4 therapy, with mutational signatures and alterations in specific genes potentially providing additional predictive power.

Example 4: SU2C Cohort Study for Lung Cancer Immunotherapy

Analyse were also performed for a cohort of patients receiving lung cancer immunotherapy. For these patients with metastatic lung cancer treated with anti-PD1/PD-L1 therapies at the Dana-Farber Cancer Institute, whole exome sequencing was performed from the clinically annotated pre-treatment biopsies, including: 36 "pairs" of samples (pre-treatment tumor+matched germline normal tissue) and 3 "trios" of samples (LUAD-1020: 4 pre-treatment tumors (1 primary+3 metastases); LUAD-1007: 2 pre-treatment tumors; and LUAD-1011: 2 pre-treatment tumors). The baseline clinical characteristics and prior therapies is summarized in Table 6 below.

TABLE 6

| Characteristic | Patients (N = 39) |
|---|---|
| Age (years) - Median (range) | 60 (32-83) |
| Age >75 - No. | 3 (7.7) |
| Male sex - No. (%) | 15 (38.5) |
| Smoking status - No. (%) | |
| Current | 11 (28.2) |
| Former | 17 (43.6) |
| Never | 11 (28.2) |
| No. of prior systemic regimens - No. (%) | |
| 0 | 3 (7.7) |
| 1-2 | 19 (48.7) |
| 3-4 | 16 (41.0) |
| 5-6 | 1 (2.6) |

Figure 15:
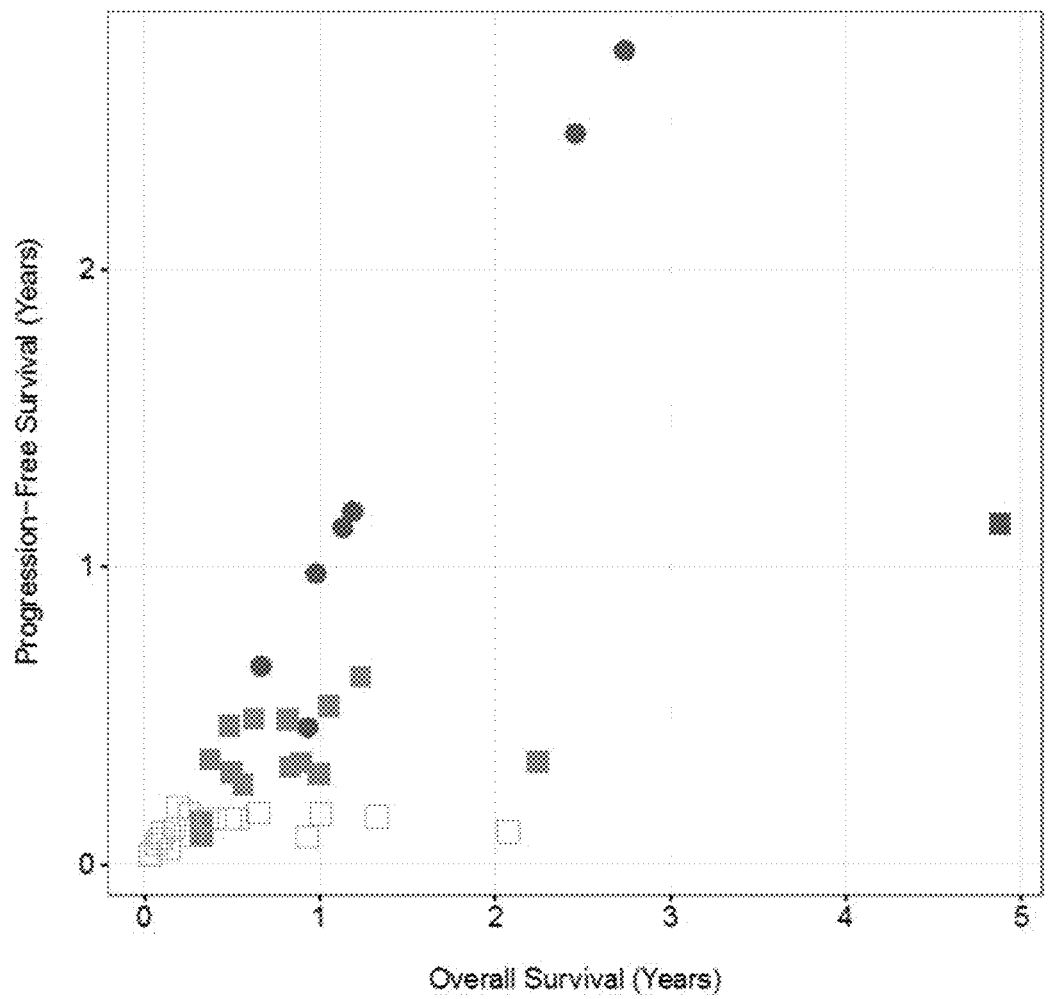
FIG. 15 depicts the different responses of 39 SU2C lung cancer patients to ati-PD-1/PD-L1 therapy.
Figure 16:
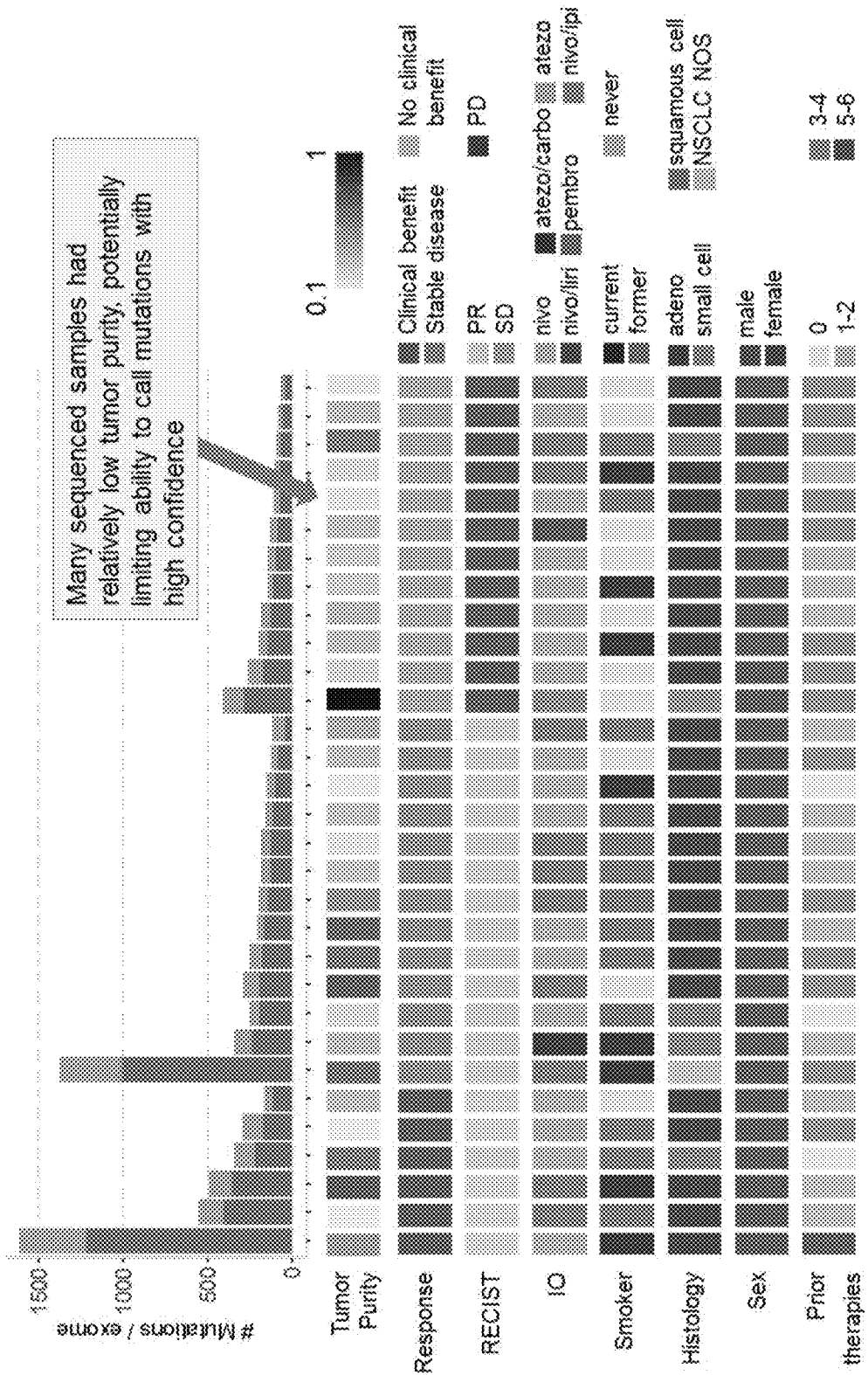
FIG. 16 shows the mutational burden and response to immune checkpoint therapies of each patient (N=31).
Figure 17:
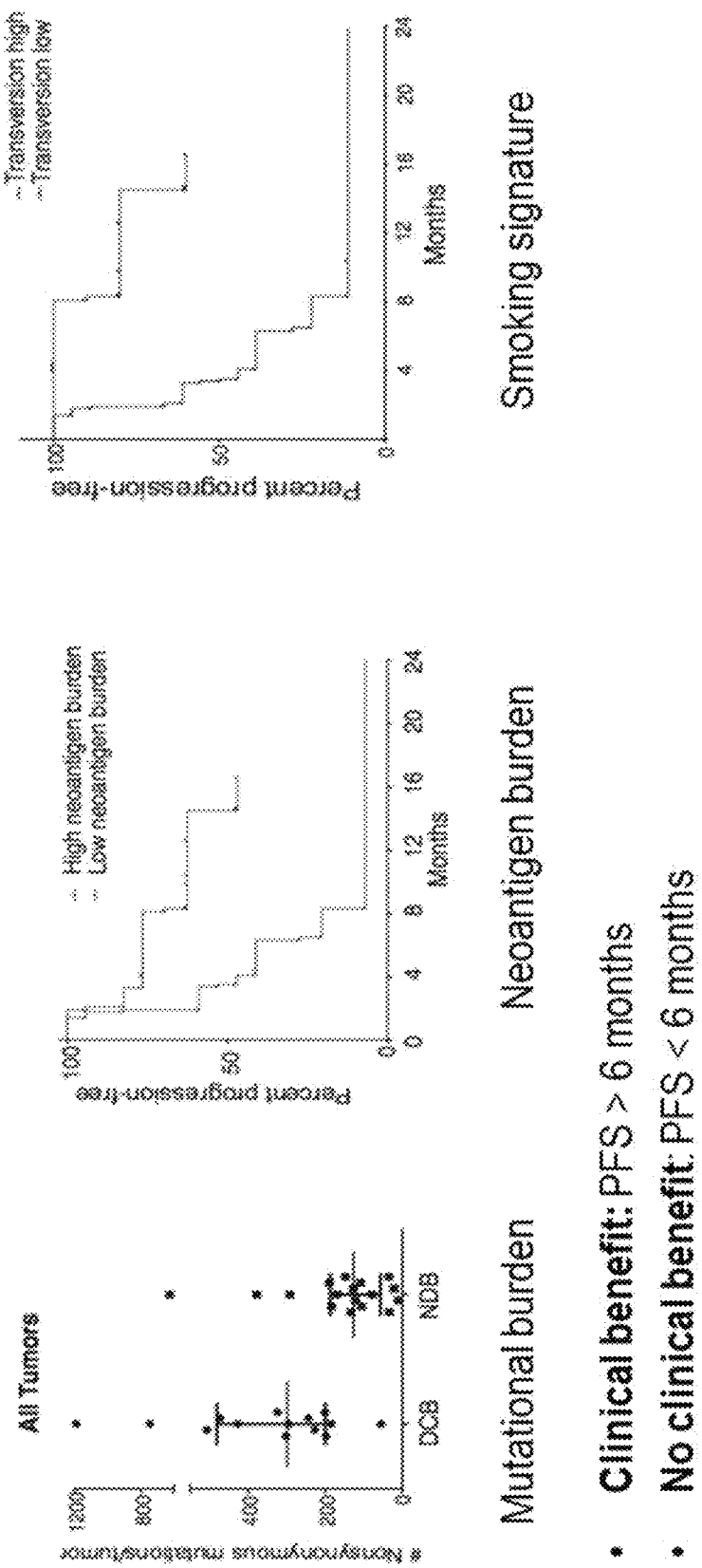
FIG. 17 shows the relationship between clinical burden and clinical benefit in a cohort in Rizvi et al. (2015) Science 348:124-128. RECIST was not taken into account (such that 2 patients with PR and PFS of ~4 months were considered nonresponders).
Figure 18:
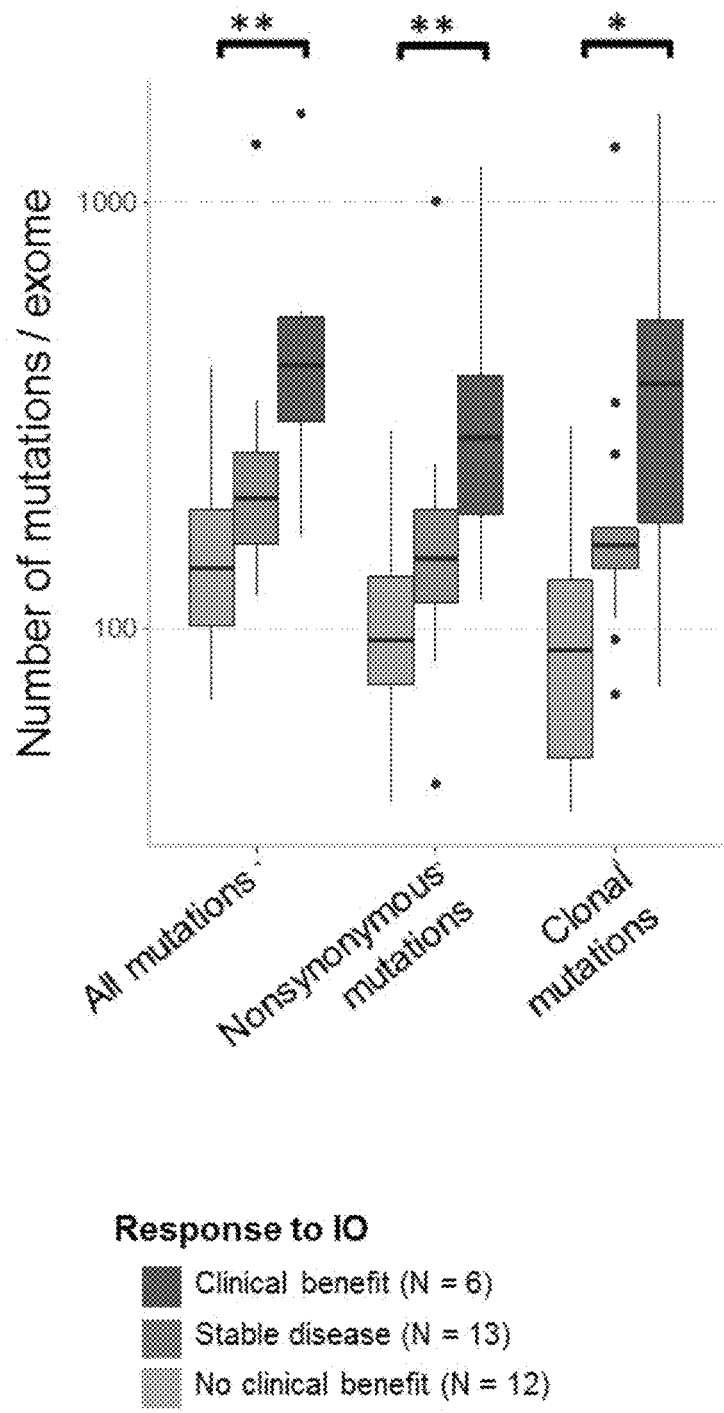
FIG. 18 shows that pre-treatment tumor mutational load was a strong predictor of response to immune checkpoint therapy in anti-PD1/PD-L1-treated lung cancer. All mutations: CB vs. NCB; p=0.003. All mutations: CB or SD vs. NCB; p=0.004. Nonsyns: CB vs. NCB; p=0.0047. Nonsyns: CB or SD vs. NCB; p=0.0064. Clonal: CB vs. NCB; p=0.024. Clonal: CB or SD vs. NCB; p=0.007. If dropping two large outliers (highest mutational load CB and SD), p-values for all mutations go to 0.009 and 0.011.
Figure 19:
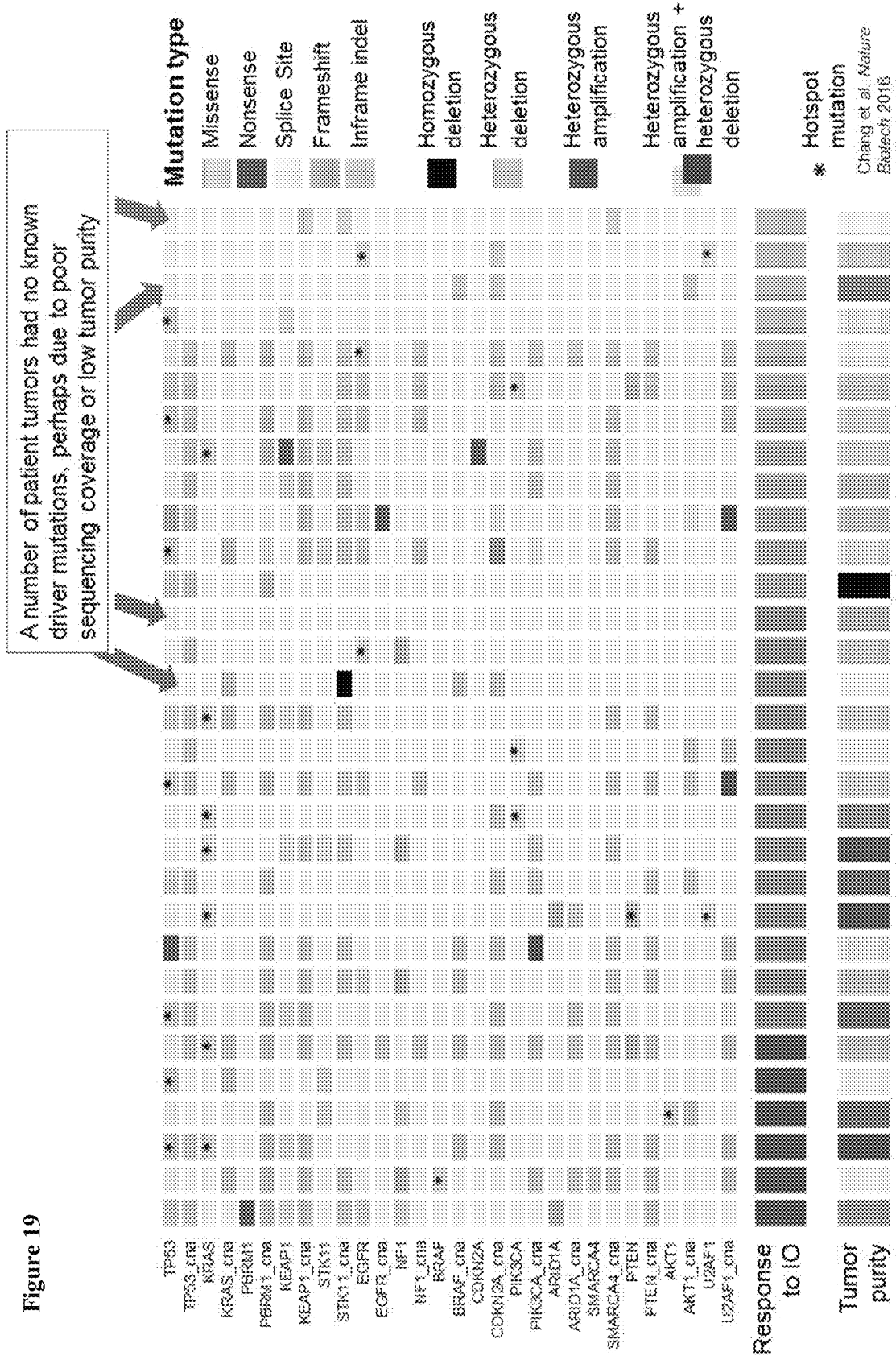
FIG. 19 shows commonly mutated genes in lung cancer. NF1 alterations were more frequent in responders (3/6 clinical benefit, 3/13 stable disease, 0/12 NCB). EGFR hotspot alterations were seen more frequently in nonresponders. KRAS hotspot alterations seen more frequently in responders (1/6 clinical benefit, 4/13 SD, 1/12 NCB). SU2C-1006: splice site mutation in MET; missense mutation in LTBP1. SU2C-1066: 3 missense mutations in LEPR. SU2C-1068: 2 missense mutations in LEPR. SU2C-1067: Missense mutations in STAG2 and SRCAP. EGFR hotspot is L858. SU2C-1066 may be excluded, since its Purity=0.36.
Figure 20:
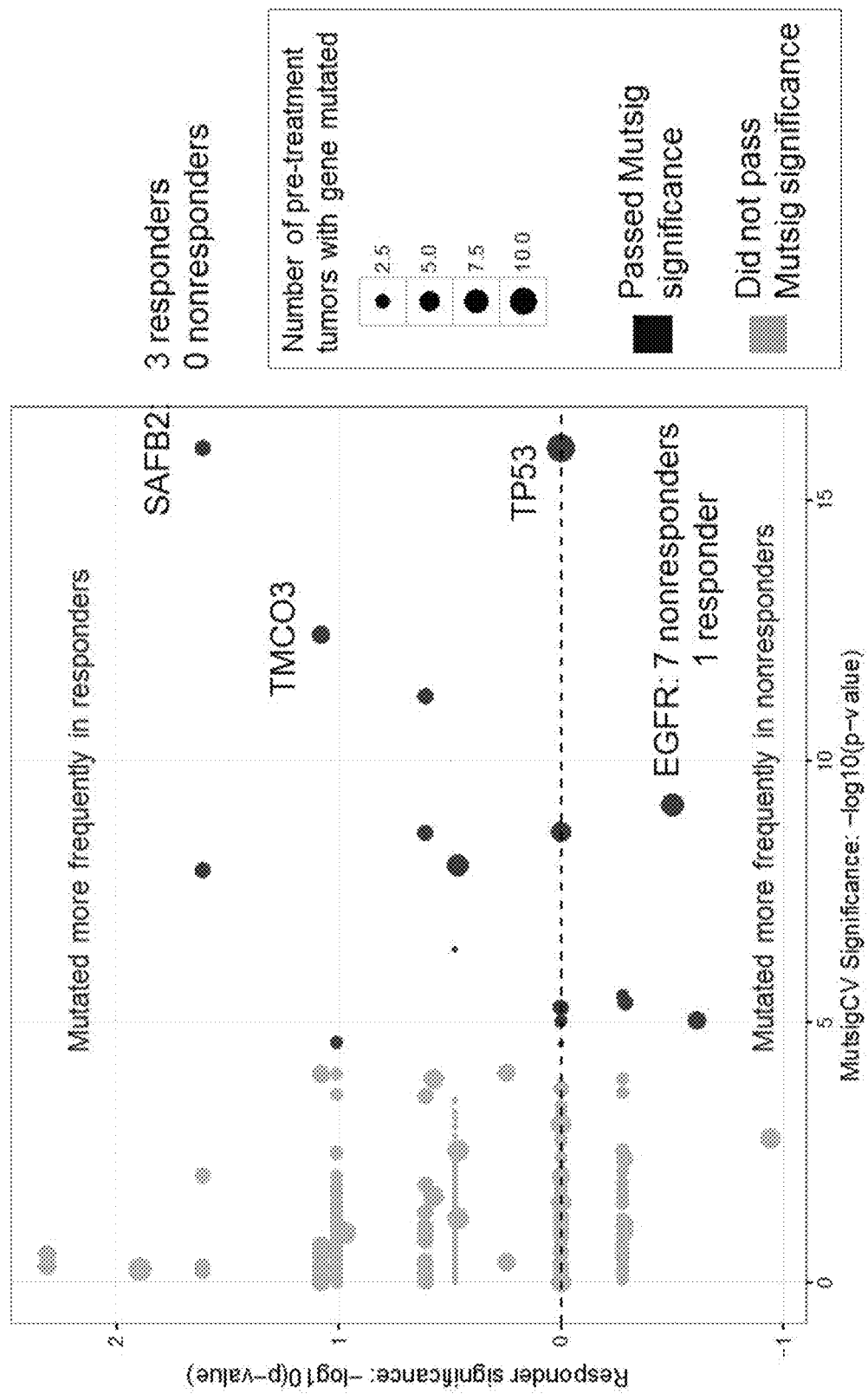
FIG. 20 shows significantly mutated genes (N=6 clinical benefit vs. 12 no clinical benefit).
Figure 21:
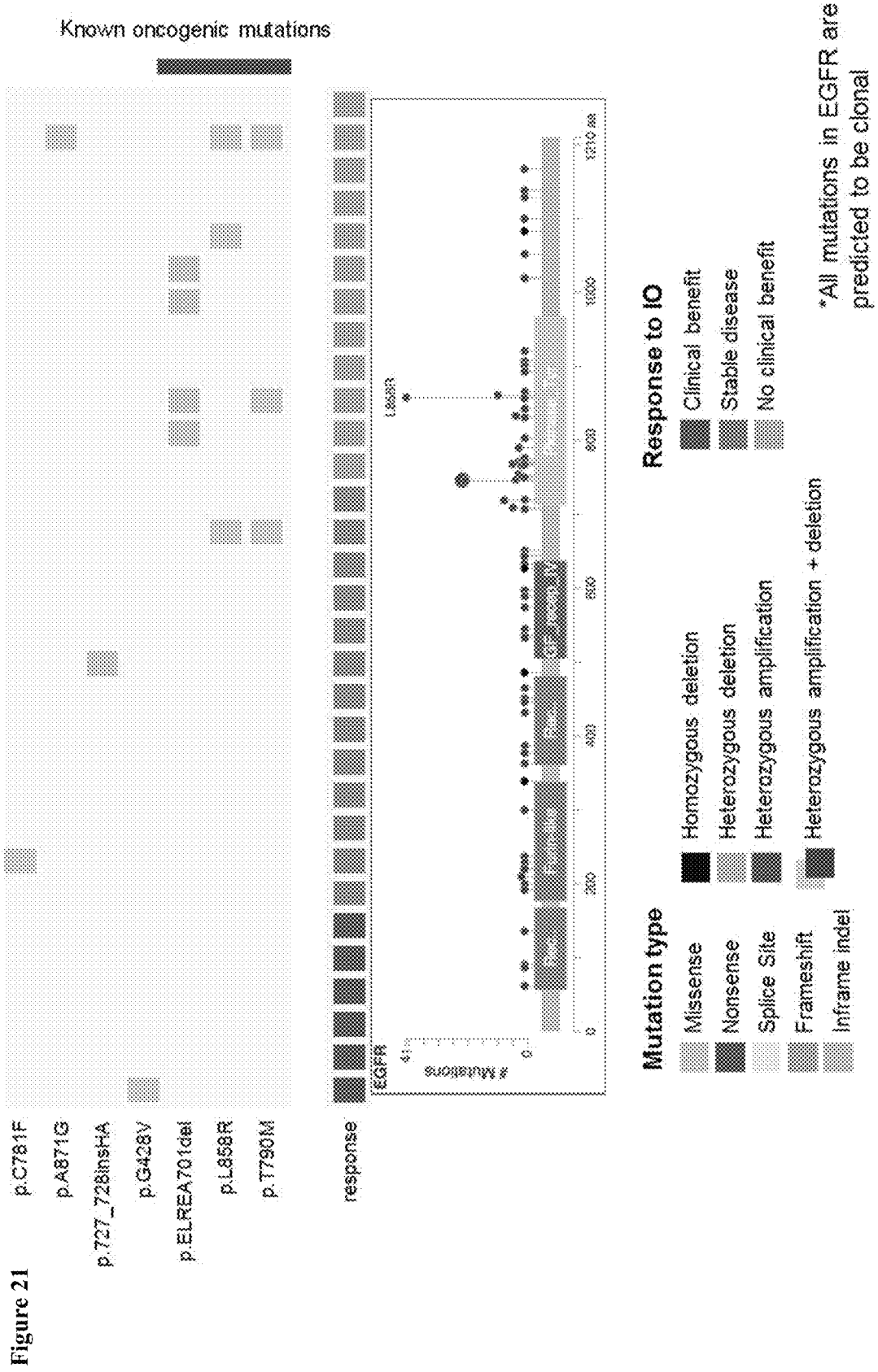
FIG. 21 shows that patients with hotspot mutations in EGFR uniformly did not respond to immune checkpoint therapy.
Figure 22:
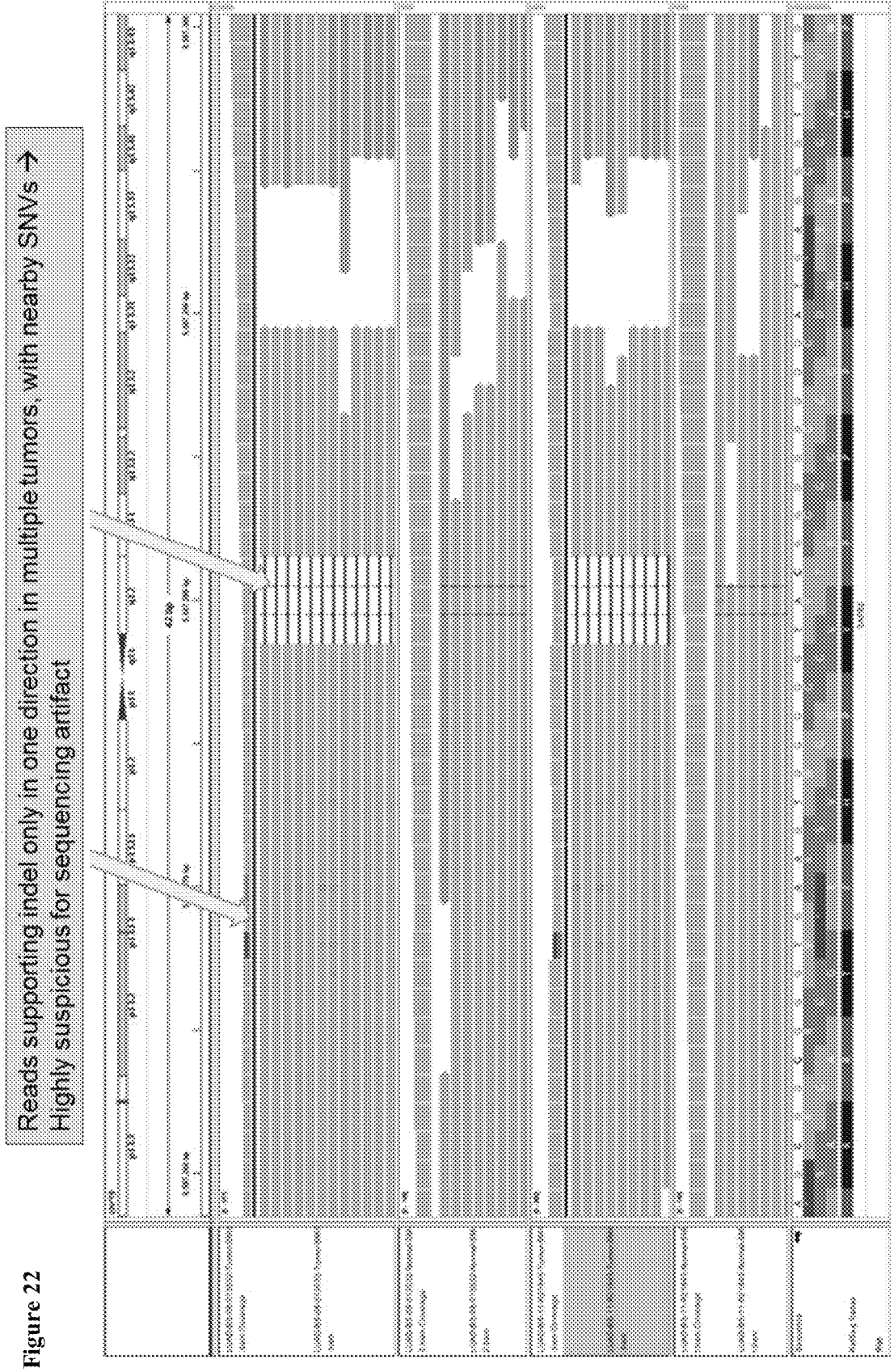
FIG. 22 shows that SAFB2 indels were likely caused by sequencing artifact.

The resulting Kaplan-Meier analysis is compared for baseline clinical variables as predictors of PFS for SU2C cohort (N=39) (FIG. 13A-13D). The corresponding quality control processes are summarized in FIG. 14. As for clinical stratification, patients were divided into three groups according to their response to immunotherapy. The definition of "clinical benefit," as for the first group of patients, includes CR or PR by RECIST or SD with PFS>12 months. The definition of "no clinical benefit" includes PD by RECIST with PFS<3 months. The definition of "stable disease" (intermediate clinical benefit) includes SD with PFS<12 months or PD with PFS>3 months. A summary of different responses of 39 SU2C lung cancer patients to immunotherapy is shown in FIG. 15. Their mutational burden and response to immune checkpoint therapies is also compared (FIG. 16, N=31). Another cohort previously reported by Rizvi et al. (2015), supra was similarly analyzed (FIG. 17 and FIG. 18), showing that pre-treatment tumor mutational load was a strong predictor of response to immune checkpoint therapy in anti-PD1/PD-L1-treated lung cancer (FIG. 18). The current cohort of lung cancer patients were tested for any mutations to genes commonly mutated in lung cancers. As shown in FIG. 19, NF1 alterations were more frequent in responders (3/6 clinical benefit, 3/13 stable disease, 0/12 NCB). EGFR hotspot alterations were seen more frequently in nonresponders. KRAS hotspot alterations were observed more frequently in responders (1/6 clinical benefit, 4/13 SD, 1/12 NCB). The following provides additional genetic observations: SU2C-1006: splice site mutation in MET; missense mutation in LTBP1; SU2C-1066: 3 missense mutations in LEPR; SU2C-1068: 2 missense mutations in LEPR; SU2C-1067: missense mutations in STAG2 and SRCAP and an observed EGFR hotspot was L85. Sample SU2C-1066 may be excluded since its purity=0.36. A summary of significantly mutated genes in these patients is shown in FIG. 20. Patients with hotspot mutations in EGFR uniformly did not respond to immune checkpoint therapy (FIG. 21). SAFB2 indels were likely caused by sequencing artifacts (FIG. 22).

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the world wide web and/or the National Center for Biotechnology Information (NCBI) on the world wide web.

EQUIVALENTS

Those skilled in the art will recognize, or be able to ascertain using no more than routine experimentation, many equivalents to the specific embodiments of the present invention described herein. Such equivalents are intended to be encompassed by the following claims.

SEQUENCE LISTING (117 sequences)

SEQ ID NO: 1 - DNA, 7592 bp, Homo sapiens
gcggccgcggccggaggagcaatagcagcagccgtggcggccacggggcggggcgcggcggtcggtgaccgcggccggggctgcaggcggcggagcggctggaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccaggaaaaaaaaaaaaaaaaaa

SEQ ID NO: 2 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSESTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 3 - DNA, 7609 bp, Homo sapiens
gcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaat

SEQ ID NO: 4 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 5 - DNA, 8117 bp, Mus musculus
ggatttacggcagcactgggaggggtgagggcggtgagggcggcgggtgccggagagacggccgcggccagaggagcgctagcagccgtggcggccacggggcggggctcggcggtcggggaccgcagccggggctgcaggcggcggagcggcgggcttgccaacacttggtgtcacatgtgagcctcccacatgtgtgcactctccattccagctctgtgattgaactctgctcttattgactagggggcacttgggcaggcatgcttcattcctggagttgacagtcatttcataagaagttggattccatgggttccaagagaagaagagccacctctccttccagcagtgtcagtggagactttgatgacgggcaccattctgtgcctacaccaggcccaagcaggaaaaggagaagactgtccaatcttccaactgtagatcctattgctgtgtgccatgaactctataacaccatccgagactataaggatgaacagggcagactcctctgtgagctgttcattagggctccaaagcggagaaatcaaccagactattatgaagtggtttctcagcccattgacttgatgaaaatccaacagaaacttaaaatggaagagtatgatgatgttaatctactgactgctgacttccagctgctttttaacaatgcaaaggcctactataagccagattcccctgagtataaagctgcttgtaaactctgggatttgtaccttcgaacaagaaatgagtttgttcagaaaggagaagcagacgatgaagatgatgacgaagatgggcaagacaatcaaggcacactggctgacggctcttctccaggttatctgaaggagatcctggagcagcttcttgaagccatagttgtagccacaaatccatcaggacggctcatcagtgaactttttcagaaactgccttccaaagtgcaatatccagactattatgcaataattaaggaacctatagatctcaagaccattgctcagaggatacagaatggaagctacaaaagtatacacgcaatggccaaagatatagatcttctagcaaaaaatgccaaaacatacaatgagcctgggtctcaagtattcaaggatgccaattcgattaaaaaaatattttatatgaaaaaggcagaaattgaacatcatgaaatgactaaatcaagtcttcgaataaggactgcatcaaatttggctgcagccaggctgacaggtccttcgcacaataaaagcagccttggtgaagaaagaaaccccactagcaagtattaccgtaataaaagagcagtccaagggggtcgcttgtcagcaattaccatggcacttcagtatggatcagagagtgaagaggacgctgctttagctgctgcacgctatgaagaaggggaatctgaagcagagagcatcacttccttcatggacgtttccaacccctttcatcagctttacgacacagttaggagctgtaggaatcaccaagggcagctcatagctgaacctttcttccatttgccttcaaagaaaaaatacccagattattatcagcaaattaaaatgcccatatcacttcaacagatcagaacaaagctaaagaaccaagaatatgaaactttagatcatttggagtgtgatctgaatttaatgtttgaaaatgccaaacgttataacgttcccaattcagccatctataagcgagttctaaaactgcagcaagtcatgcaggcaaagaagaaggagcttgcgaggagagatgacattgaggacggagacagcatgatctcctcagccacttctgacactggtagtgccaaaaggaaaaggaatactcatgacagtgagatgttgggtctcaggaggctatccagtaaaaagaacataagaaaacagcgaatgaaaattttattcaatgttgttcttgaagctcgagagccaggttcaggcagaagactttgcgatctatttatggttaagccatccaagaaggactatcctgattattataaaatcatcttagagccaatggacctgaaaataattgagcataacatccgaaatgacaaatatgcaggtgaagaaggaatgatggaagacatgaaactcatgttccgcaatgccaggcactacaatgaggagggctcccaggtatacaatgatgcccatatcctggagaagttactcaaagataaaaggaaagagctgggccctctgcctgatgatgatgacatggcttctcccaaacttaaattgagtaggaagagtggtgtttctcctaagaaatcaaagtacatgactccaatgcagcagaaactgaatgaagtgtatgaagctgtaaagaactatactgataagaggggtcgccgccttagtgctatatttctaagactcccctctagatcagagctgcctgactactacctgaccattaaaaagcccatggacatggaaaaaattcgaagtcacatgatggcaaacaagtaccaagacatagattctatggtagaggactttgtcatgatgtttaataatgcctgtacctacaatgaaccagagtctttgatctacaaagatgcccttgtactgcataaagtcctccttgagactcggagagacctggagggagatgaggattctcatgtccctaatgtgacgttgctgattcaagagctcatccataacctttttgtgtcagtcatgagtcatcaggatgacgaagggaggtgttacagcgactccttagcagaaattcctgctgtggatcccaactctcccaataaacctccccttacatttgacattatcaggaaaaatgttgaaagtaatcggtatcggcgacttgatttatttcaggagcatatgtttgaagtattggaacgggcaagaaggatgaaccggacagattccgaaatatatgaggatgctgtagaacttcagcagttttttattagaattcgtgatgaactctgcaaaaatggagagatccttctttctccagcactcagctataccacaaaacacttgcataacgatgtggaaaaagaaaaaaaggaaaaattgcctaaagaaatagaggaagataaactaaaacgcgaagaagaaaaaagagaagctgaaaaaagtgaagattcctcaggtactacaggcctctcaggcttacatcgtacatacagccaggactgcagctttaagaacagcatgtatcatgtcggagattatgtctatgttgaacctgcggaggccaatctacaaccacatatagtgtgtattgagagactgtgggaggattcagctggtgaaaaatggttgtacggctgttggttttatcggccaaatgaaacattccatttggctacacgaaaatttctagaaaaagaagtttttaagagtgactactacaataaagtacctgttagtaaaattctaggcaaatgtgtagtcatgtttgtcaaggaatactttaaattatgtccagaaaactttcgcgatgaggatgtttttgtctgtgaatcgaggtattctgccaaaaccaaatcttttaagaaaattaaactgtggaccatgcccatcagttcagttagatttgtccctcgggatgtgcctttgcctgtggtccgagtggcctctgtgtttgcaaatgcagataaaggggatgatgagaagaatacagacaactcagatgacaatagagctgaagacaattttaacttggaaaaggaaaaagaagatgttcctgtggagatgtccaatggtgagccaggttgccactactttgagcagcttcggtacaatgacatgtggctgaaggttggtgattgtgtcttcatcaaatcccacggcttggtgcgccctcgtgtgggcagaattgagaaagtatgggtccgagatggagctgcatatttttatggccctatcttcattcatccagaagaaacagaacatgagcccacaaaaatgttctacaaaaaagaagtgtttctgagtaatctggaagagacctgccctatgagttgtattctggggaaatgtgcagtgctgtcattcaaggacttcctctcctgcaggccaactgaaataccagaaaatgacattctgctttgtgagagccgctataatgagagtgacaagcagatgaagaagttcaagggtttgaagaggttttcactctctgctaaagttgtagatgatgaaatctactacttcagaaaaccaatcattcctcagaaggaaccctcacctttgttagaaaagaagatacaattgctagaagctaaatttgcagagttagaaggaggagatgatgatattgaggagatgggagaagaggatagtgaagtcattgaagctccatctctacctcaactgcagacacccctggccaatgagttggacctcatgccctatacacccccacagtctaccccaaagtctgccaaaggcagtgcaaagaaggaaagttctaaacgaaaaatcaacatgagtggctacattttgttcagcagtgaaatgagagctgtgattaaagcccagcacccagactactcttttggggagctcagcagactggtggggacagaatggagaaaccttgaaacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggcatgatgggtggctatccgccaggccttccacctttgcagggcccagttgatggccttgttagcatgggcagcatgcagccacttcaccctggggggcctccacctcaccatcttccgccaggtgtgcctggcctcccaggcatcccaccaccgggtgtgatgaatcaaggagtagcccccatggtagggactccagcaccaggtggaagtccgtatggacaacaggtaggagttttgggacctccagggcagcaggcaccacctccatatcctggtcctcatccagctggcccccctgtcatacagcagccaacaacgcccatgtttgtggctcccccaccaaagacccaaaggcttctccactcagaggcctacctgaaatacattgaaggactcagtgctgaatccaacagcattagcaagtgggaccaaactttggcagctcgaagacgggatgtccatttgtccaaagaacaggagagccgcctaccttctcactggctcaaaagtaaaggggcacacaccaccatggcagatgccctctggcgcctacgggatttaatgcttcgagacactctcaacatccgacaggcatacaacctagaaaatgtttaatcacatcactgtttcttctgtggaagcaaagagttgtggagcggtagccattttagttactggggtgggagggaggaacaaaggatgataatttttattgcattttattgtacatcacacagccatttttatataaggacacttttaataagctatttcaaatttggttttgttacattaagttgactatcaaatacacaaaagattttttttgcatatgtttcctttgtttaaaaccagtttcataattggttatatatagtaatagttttatctttacttgttaaaggacttaaatcatcaaaggttttggcttggcttagggttttcgttttcttttttataaatatatattatatatatatacacatataaaagaaaaaatgaaaaaaaagtttacaaatttaagttgacaatgaaatgtgaagttggtcctagtttacatcttagaggaatgtatatgtatgttttacatgcctaaatatctgcaggttttcttacaggtaaagcgaagtgctttgaaaagtttagattatacatgtgtgacagatgcggcatatttgctctattaacacagaggcttactatagaaatctaaagtcaatgctgtacatccatccagttagtgtaactgaagggaaatgtaactttgtgctgagttagacatctgtattgtcagtgattcttgtagaatatgtgctcagatctgagttatatttagttttggaaggtaagttgaagagtacttttgatcagtttatgattcagtttatgattttagtttttgccttcatgttatacatttatgatttgaaactgtacatctgttaccttgaaaaacattgaagaaagtactgaagtgtgcatggaggtggtttaagcataatacttaacccaagaaagagtgtaagtggacacaagctgtgcctgcacatagctgtgcagggtagactgcctacatacacatggccgggattctttatttccttgttatcaattatagtgctttgtttgtttcagggttggaattctcaaccagaaataatactttctaaaatattttaaaattcagcttgtgctttggattatagaaggaaattatactttaagaaaatgttcacaaaaaaaaaaaaaaaaaaaggactattacagatcccaatacttggatttggtgaccttgtctttctttcttttcttgagacatggtcctactaccaaccctggctggactggagctcagtgtatagaccaggctagtctcaaactctgcctcttcctcccaagtgctgggattaagggcaggtaccatagtgctcagcaaccacaaccctgtctttccaacacggccctagcgtaagcactgaggcagtgtgcagtgctcaggcagcagcaaacatttcccgggggtggttttgaacctgcttgggtggttgtgtggtgctgacgctgccactgccctgttgttcattgagaatgattgttaaatgacactcttcctttagaatataacggatcagtactcatgtttaattgccatgcttaataaatcatgagaacaaaagagtatagaatggaaagcattccctggtagctactttaaatacaggagccctgtaacttaataccagtagtcaaccactggatctcagttttcatcaagtattttaaataaataatcttaaattttaaaatacgtactgcagagtatgccagtatcttattgttaaaactgaatcaaataaatcttcgattcctggttatttggaccattgactcatcatggactatataatgtaataagattcttttctcttaaggtatccttgaattacaccaaagaaccagaaacttaattttggttaaattatttatttatttcatgcattaattttctttttctttttaaaggtttagatgaggctccttagggagtctctaaaaccgcttcactatcagcaaccaggagtactagaagccagagcactcttcctcctggctcctccccagtgctctagtgctgtaggaaccaagagccagccccaggttccccgaggcagtaaaaatccagcacagggggctgtgtccctaaggcaagccctgattacctttaaaaaaaaccaaaaaaacaaacaaaaaaaaaaaacctaattaactaaagcatttaaggcactatttattttagaatcatgcttttgaagagcatcagtgattacttagggtgtaatatgtaaagatcagacatctccaaaaacagaaaaagtacaagtaaacaacacactttctcatgacttttaagaactgtagtaatgtggcttaggaaatataatggcctaattgttttcaaaatgtaagttcctgtgaagaattttgtttatattgggttggggacctataggtttaaaatagaatgtcagtcagctgacttaaaaaacattggttttactaagtctgccttccccttctaaggaagaactgagtgggtaagggacaggtgtgtaaaatctccaaatggatgttacagctttcagcttgaacgtttgtttccagacctgattaaaatttggtttattctaatttctgtactatatcatctgaggttttaagtggtaactggttctataccatgtatgtatcatatgtttgttcatcaaagctttttaatccaaataaaaacaacagtttgcaaagtga

SEQ ID NO: 6 - protein, 1704 aa, Mus musculus
MGSKRRRATSPSSSVSGDFDDGHHSVPTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKAYYKPDSPEYKAACKLWDLYLRTRNEFVQKGEADDEDDDEDGQDNQGTLADGSSPGYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMTKSSLRIRTASNLAAARLTGPSHNKSSLGEERNPTSKYYRNKRAVQGGRLSAITMALQYGSESEEDAALAAARYEEGESEAESITSFMDVSNPFHQLYDTVRSCRNHQGQLIAEPFFHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMMEDMKLMFRNARHYNEEGSQVYNDAHILEKLLKDKRKELGPLPDDDDMASPKLKLSRKSGVSPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNSPNKPPLTFDIIRKNVESNRYRRLDLFQEHMFEVLERARRMNRTDSEIYEDAVELQQFFIRIRDELCKNGEILLSPALSYTTKHLHNDVEKEKKEKLPKEIEEDKLKREEEKREAEKSEDSSGTTGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSDDNRAEDNFNLEKEKEDVPVEMSNGEPGCHYFEQLRYNDMWLKVGDCVFIKSHGLVRPRVGRIEKVWVRDGAAYFYGPIFIHPEETEHEPTKMFYKKEVFLSNLEETCPMSCILGKCAVLSFKDFLSCRPTEIPENDILLCESRYNESDKQMKKFKGLKRFSLSAKVVDDEIYYFRKPIIPQKEPSPLLEKKIQLLEAKFAELEGGDDDIEEMGEEDSEVIEAPSLPQLQTPLANELDLMPYTPPQSTPKSAKGSAKKESSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 7 - DNA, 8619 bp, Homo sapiens
ggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaaaaaaaaaaaaaaaaaaaaaaa

SEQ ID NO: 8 - protein, 1835 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 9 - DNA, 5703 bp, Homo sapiens
ggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaaaaaaaaaaaaaaaaa

SEQ ID NO: 10 - protein, 1788 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRR

SEQ ID NO: 11 - DNA, 9029 bp, Mus musculus
gcgccgccgccgccgccgccgccgccgccgccgccgccaccgccggcccatgactgagccccgccaccgccggccgaggaatgggctccgggcgctggtagggagcgcggggagcgggggccgcgtttgaaccgcgatctgggttttttcgggagacctcctttggcaaaataatggcaaactcgacggggaaggcgcctccggacgagcggaggaagggactggctttcctggacgagctgcggcagttccaccacagcagagggtcgccgtttaagaagatccctgcggtgggtgggaaggagctggatcttcacgggctctacaccagagtcactactttaggcggattcgcgaaggtttctgagaagaatcagtggggagaaattgttgaagagttcaactttcccagaagttgttccaacgctgcctttgctttaaaacagtattacttgcgttatctagaaaagtacgagaaagttcatcattttggggaagatgatgatgaggtaccaccaggcaatccaaagccacagcttcctattggtgcaatcccatcttcctacaattaccagcaacacagcgtgtcagattatctacgtcaaagttatgggttatctatggattttaattcgccaaatgattataataaactggtgctttcactgttatctggactcccaaatgaagtggacttcgctattaatgtgtgcactctcctatcaaatgaaagcaagcacgtcatgcagcttgagaaggatcccaaaatcatcactttactgctcgctaatgcgggggtgttcgatgacactttaggatcattctcttctgtctttggagaagagtggcgagagaagactgatagagactttgttaagttttggaaagacattgttgatgacaatgaagtgcgagatctcatttctgacagaaacaaggctcatgaagatacaccaggagaatggatttgggaatctttatttcatccacctcgaaagctgggcattaatgacatcgaaggccagcgggttctgcagatcgcagtgatcttgcggaacctctcctttgaggagagcaatgttaagctcttggcagctaatcgcacctgtctgcgtttcctgttgctctctgcacacagtcattttatttcattaaggcagctaggcctggacaccttagggaatatcgcagctgagcttttactggaccctgtggatttcagaaccactcatctgatgtttcacactgttacaaaatgcctgatgtcaagggataggtttttaaagatgaggggcatggaaattttgggaaatctctgcaaagcagaggataacggtgttttgatttgtgaatatgtggatcaagattcctatagagagataatttgtcacctcactctgcccgatgtgctgctggtgacctcaaccctggaggtgctgtacatgctcactgaaatgggggacgtggcctgcacaaagatcgcgaaagtggagaagagcatagacgtgctggtgtgtctggtctctatggacgctcagatgtttggacctgacgcacttgctgccgtgaagctcattgagcatccgagctccagtcaccaagtgttatcagagattaggccgcaagccatagagcaggtccaaacccagacccacatagcctccggtccagcttccagagcagttgtagcacagcatgctgccccccctccaggaatcgtggaaatagacagtgagaagttcgcttgtcagtggctaaatgctcattttgaagtaaatccagactgttccgtctctcgggcagaaatgtattcagagtacctctcaacttgcagtaaattagctcgcggtggcatcctcacatcaactgggttttataagtgtcttagaacagtttttccaaatcatacagtgaagagggtagaagattccactagcagtgggcaggcgcatatccatgtcataggagtgaagcggcgggctctcccgctccccatccagatgtactatcagcagcagccaatttccactcctgttgtccgtgttgatgctgttgctgatctatctccaactccttcacctgcaggaatccctcatggaccacaggctgcagggaatcattttcagaggactcctgtcaccaatcaatcttcaaatttgactgcaacacaaatgtcttttccggtacaaggcattcatactgtggcacagactgtttccagaattccaccaaatccttcagttcatacccaccagcaacaaaattctccagtaactgtcattcagaataaagctccaattccttgtgaagtcgttaaggcaacagtaatccagaactctgtgccccagacggcagttcctgtgagtatctctgttggaggagcacctgcacagaattctgtgggtcagaaccatagtgcagggccacagcctgttacagttgtaaattctcagacattacttcaccatccttctgtgatgccacagccatctccactacacacagtggtgcccggacaggtcccttcaggcactcctgtcacagtaatccagcagactgtaccgcagagtcgtatgtttggacgagtacagagcataccagcgtgtacatctaccgtctcacagggtcagcagttaatcaccacatcaccacagcctatgcacacttcatctcaacagacagcagctggtagccagccacaagacactgttatcatagcacccccacagtacgtaacaacttctgcatccaatatcgtctcagcgacttcagtacagaatttccaggtagctacaggacaggtggttaccatagctggtgtcccgagcccacagccctccagggtaggattccagaacattgcgcccaagccacttccttctcagcaagtttcaccatcagtggtccagcagcctattcaacaaccacagcagcctgctcagcagagtgtagtgattgtgagccagccagcacagcaaggccaggcgtacgcaccagccattcaccagatcgttctcgctaacccggcagctctccctgccggtcagacggttcagctaactggacaaccaaacataactccatcgtcatcaccatcacctgtcccgcctactaataaccaagtccctactgccatgtcatcttcttccacccttcagtcacagggaccccctcctactgtcagtcagatgctctctgtgaagaggcagcagcagcagcagcactcaccagcagcgccagcacagcaggtccaggtccaggttcagcagccgcagcaggtccaggtgcaagttcagccgcagcaaccgagtgctggggtcggtcagcctgctcccaacgagtctagtctcatcaagcagctgctgctgccaaagcggggcccttcaaccccagggggcaagcttatcctcccagcccctcagattcctccccctaacaatgcaagagctcctagccctcaggtggtctatcaggtggccaataaccaagcagctggttttggagtgcaggggcaaactccggctcagcagctattggttgggcagcaaaatgttcagttggtccaaagtgcaatgccacccgcagggggagtgcaaaccgtgcccatttcgaacttacaaatattgccgggtccgctgatctcaaacagcccagcaaccattttccaagggacttctggcaaccaggtaactataacagttgtgccaaataccagttttgcaactgcgactgtgagtcagggaaacgctgctcagctcattgcgccagccggtcttagcatgagcggagcgcaggcaagcgctggacttcaggtgcagacgcttccagccggacaatcagcgtgtaccactgctcccctcccgttcaaaggcgacaagatcatttgccaaaaggaggaggaggcaaaggaagcaacaggtctacatgttcatgaacggaagattgaggtcatggagaatccttcctgtcggcgaggaaccacaaacaccagcaacggggatacaagtgagagtgaactccaggtgggaagtcttttaaatgggagaaagtatagtgactcaagtctacctccttcaaactcagggaaacttcagagtgagacgagccagtgctcactaatcagcaatgggccatcgttggaactaggtgagaatggagcgcctggaaaacagaactcagaaccagtagacatgcaggatgtcaaaggtgatctgaaaaaagccctcgtcaatggaatctgtgattttgataaaggagatggttctcatttaagcaaaaacattccaaatcacaaaacttctaatcatgtaggaaatggtgagatatctccagtagaaccacaagggacttcgggtgccactcagcaagatactgccaaaggtgaccaactagaaagagtttctaatggacctgtgttaactctgggtgggtcaccgtccacaagcagtatgcaagaagccccgagtgtggcgacaccgccgttgagtggtactgacctgcctaacggacctctagcttcaagtttgaattcagatgtgcctcagcaacgcccaagtgtagttgtctcaccacattctacagcccctgtcatacaggggcatcaagtcatagcagttccccactcaggacctagagtgaccccttctgctctatcatctgatgctcggtctacaaacggcacagccgagtgcaaaactgtaaagaggccggcagaggataatgatagggacactgtcccgggaatcccaaataaagtaggggttagaattgttacaatcagcgaccccaacaatgctggctgcagtgcaaccatggttgcggtcccagctggagcggacccaagcactgtagcgaaagtagcaatagaaagtgctgctcagcaaaagcagcagcatccaccgacctacatgcagagtgtggccccacagaacactcctatgccaccttcaccagctgtacaagtgcagggccagcctagcagttctcagccttctccagtcagtgcgtccagtcagcatgcagatccagtgagaaaacctgggcagaacttcatgtgtctgtggcagtcttgtaaaaagtggtttcagactccctcacaagtgttctatcatgcagctactgaacatggaggaaaagatgtgtatccggggcagtgtctttgggaaggctgtgagcctttccaacggcagaggttctctttcattacccacttacaggataagcactgttcaaaggatgccctgcttgcaggattaaagcaagatgaaccaggacaagtggcaaatcaaaaatcttctaccaagcagcccaccgtggggggcacaggctctgcgcccagagcccagaaggccattgcaagccaccccagtgctgcactcatggctctgcggagaggctcaaggaacctcgtcttccgggacttcacagatgaaaaagagggaccaataactaaacacatccgactaacagctgccttaatattaaaaaatattggtaaatactcagagtgtgggcgcagattgttaaagagacatgaaaacaacttatcagtgctcgccattagtaacatggaagcttcctctacccttgccaaatgcctttatgaacttaattttacagttcagagtaaagaacaagaaaaagactcagaaatgctgtagtgaatcctaccccactgacacagtggggtctcaaagtcaaatacatttcacatactgttactgaagaaagcaccaagtcttaatggagcagagaccatagaatgaattattttgtgtcctccatgatgctgagaggaaacttcgtattctgatctctgaacgaatccctttcttttctgttaaaaaaaaaaaatctaaaaaggaaaaaaaaaaaaaaaaaaacaaaaactgctgtgggattgtcaaccagcttatctgcaggatgtctcggatctggccaatcctgatggaaactggtgtgatcagaattctgtaccatccacattggaatatacatggaatagtgtaaaacctacgtgagcagatgaaatagaagcattaaatatttttatctatatccaaaaaggagcacatttttatatttacagaaccatttaagctggtttgaataacgacagagtttgagcacacctatcccccagcttcagaggggccaccaatatctagctgtggattgtgtgttttgtttagaatcagtagcttggttttcttacttgagccaatatattttcacttatttattatcataaaaatttaccagtctgaatagatcttgtaaatatttgtgaatagaatgaacactgttcataccactgcagccactggagatacatcctgtggtgtcctagaagcattatcggtaggctctaaagttttctagactttgctgtcaactgtaagtaattgtgatatattctacgcagtggatggatattctttaaatctgtgtaaatacttctgcaaaggtactgatgctgtaaagtcaaacagttttgtggaactgtgattttttttttcctccttttttggtttccttggcccccacttgggtttggtggggttttgtttttgttttgttttgtattatacaccttgtagaactcattttgctggctgaaagagtatggaataatatatctcatatgtcatttttgtagaagagaaactatttggatttcctttttgttggtttggttttccctaacacgtgtccgctgtacgcattcgtcacgtgcaagctcagcttgtgcagggttttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttcccccaagcgtgaaatgtatccacttataactgcctattgcctgttctattagcatccaaaaatgtggaaggcctcccaaccaccatttctgctgtgtccttaggatgtgcagtaaaaaaatatagacctgacagtttatgttatagaatggctttatttactttggtgactgtttatagtttttaaataaaagactgaacattttcttgagtcctttatttctgagtatgcttaagacattctaaaatttaaagtctagctgaaggcaaggtcaaacggtcacctacttactttatactttgtgattgtagagaacagaaaggtgcatcatgtgataggacaccatggtcacggtaggaaggagaccaggagaccaaatgttttgtttacagtagtatgagtagtagccccagagagcgagagacagttagggctcggttgccttactgtgtgtcccgcatctatctgactgagagctttgtttaccattcgactctaggtttcagtttaactaattcaggggcagcttcttggcaatgagcttcagtctggacagttcaaatatcttgattaatttagtaccaaaaagtaatttctccccaggggtctctgtgctctcagctctaactgtaagaaatgtgtggcgacacccagaacttggtattctcaggttggtggcgtttgacttcttcgccttagcctggggctgcccagcagacaccctgagtccaggtaccttactgtatccctcaaatatcgccagactaaaggtttctaagggcagatagttgtagaaatttatattcactgtgtttatctaaaaaaattgaggtttttgaaataatttttgtaacatcactgtttgcttgtcctcaaggtacctttttccttccaaagcaggaaattaccatggtggttagcctttagtagcagaaacgacaggcttaagaaagtggcttccatagtcaccatcctgtcacctcactgaattgcatcctgtagatgtagatttttgtgttaaaatgtataaatgtgtctttagtgcttttaagcaatggtctcagcagaattttctaaatgtatctgacctgacgaaaccaatttctagctccccttaggcttcccctccggcagctttacctgactaatggataagacttggtgggtaacgcggttgaagtgctcttgcagtccagggcctgcagaaccctcgcagtcacgaaaaggtgctccttgctagacagaaacttgctgacttccagtattgttatttttgtctaaagttctgtaaatacaagctttaatgttatctttgagagatctatgtaaataatagtcaagaacatagagactgtacaattctgtgttatatatgtgcctagtgctctgttggcacttaataaattttaagtaacaaaactgatgatcatatagtgaaggcatatttttcttccgacttgagacaggatatgactatatattaatgagactcaataaaccaagccacacatgaaaacttgtctcattactttatagccatgccatgtatgttttttaaactataaaatgacaataaaactgatttttgaaatgagtgttttggataagtgacttctgtcctgatcttataccataaataaagtactgaagacgaaatatgaagctcttacccaaaggagtagctgcttagaaacaagagtgaagcttgaagatcagccacacaggccacctcacactttgttcctgtttatcttacgatacagtaagggaaggcaccatttagagccagcttgtgttagttaaccactctcatactgcccaactcttgactgaactctggcactcaaatacttggagtgagcttccttccaaggccacagaacagagaccaaccgaattaccagctggttccatcatagctagtaaactttatctagcaacaatttccactccctgcattggtttgaaaaaaaaaatgcaaagagacagtatcaatgtatgtaagtggattcactaataatacaaccacactttaagtattaaagtggggtgagatggcttggtct

SEQ ID NO: 12 - protein, 1828 aa, Mus musculus
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSSVFGEEWREKTDRDFVKFWKDIVDDNEVRDLISDRNKAHEDTPGEWIWESLFHPPRKLGINDIEGQRVLQIAVILRNLSFEESNVKLLAANRTCLRFLLLSAHSHFISLRQLGLDTLGNIAAELLLDPVDFRTTHLMFHTVTKCLMSRDRFLKMRGMEILGNLCKAEDNGVLICEYVDQDSYREIICHLTLPDVLLVTSTLEVLYMLTEMGDVACTKIAKVEKSIDVLVCLVSMDAQMFGPDALAAVKLIEHPSSSHQVLSEIRPQAIEQVQTQTHIASGPASRAVVAQHAAPPPGIVEIDSEKFACQWLNAHFEVNPDCSVSRAEMYSEYLSTCSKLARGGILTSTGFYKCLRTVFPNHTVKRVEDSTSSGQAHIHVIGVKRRALPLPIQMYYQQQPISTPVVRVDAVADLSPTPSPAGIPHGPQAAGNHFQRTPVTNQSSNLTATQMSFPVQGIHTVAQTVSRIPPNPSVHTHQQQNSPVTVIQNKAPIPCEVVKATVIQNSVPQTAVPVSISVGGAPAQNSVGQNHSAGPQPVTVVNSQTLLHHPSVMPQPSPLHTVVPGQVPSGTPVTVIQQTVPQSRMFGRVQSIPACTSTVSQGQQLITTSPQPMHTSSQQTAAGSQPQDTVIIAPPQYVTTSASNIVSATSVQNFQVATGQVVTIAGVPSPQPSRVGFQNIAPKPLPSQQVSPSVVQQPIQQPQQPAQQSVVIVSQPAQQGQAYAPAIHQIVLANPAALPAGQTVQLTGQPNITPSSSPSPVPPTNNQVPTAMSSSSTLQSQGPPPTVSQMLSVKRQQQQQHSPAAPAQQVQVQVQQPQQVQVQVQPQQPSAGVGQPAPNESSLIKQLLLPKRGPSTPGGKLILPAPQIPPPNNARAPSPQVVYQVANNQAAGFGVQGQTPAQQLLVGQQNVQLVQSAMPPAGGVQTVPISNLQILPGPLISNSPATIFQGTSGNQVTITVVPNTSFATATVSQGNAAQLIAPAGLSMSGAQASAGLQVQTLPAGQSACTTAPLPFKGDKIICQKEEEAKEATGLHVHERKIEVMENPSCRRGTTNTSNGDTSESELQVGSLLNGRKYSDSSLPPSNSGKLQSETSQCSLISNGPSLELGENGAPGKQNSEPVDMQDVKGDLKKALVNGICDFDKGDGSHLSKNIPNHKTSNHVGNGEISPVEPQGTSGATQQDTAKGDQLERVSNGPVLTLGGSPSTSSMQEAPSVATPPLSGTDLPNGPLASSLNSDVPQQRPSVVVSPHSTAPVIQGHQVIAVPHSGPRVTPSALSSDARSTNGTAECKTVKRPAEDNDRDTVPGIPNKVGVRIVTISDPNNAGCSATMVAVPAGADPSTVAKVAIESAAQQKQQHPPTYMQSVAPQNTPMPPSPAVQVQGQPSSSQPSPVSASSQHADPVRKPGQNFMCLWQSCKKWFQTPSQVFYHAATEHGGKDVYPGQCLWEGCEPFQRQRFSFITHLQDKHCSKDALLAGLKQDEPGQVANQKSSTKQPTVGGTGSAPRAQKAIASHPSAALMALRRGSRNLVFRDFTDEKEGPITKHIRLTAALILKNIGKYSECGRRLLKRHENNLSVLAISNMEASSTLAKCLYELNFTVQSKEQEKDSEML

SEQ ID NO: 13 - DNA, 2330 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 14 - protein, 652 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEQITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 15 - DNA, 2327 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 16 - protein, 651 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 17 - DNA, 2370 bp, Mus musculus
ggtttgccggcctctcgccctctcgccactggtgtcgcgcttcggtcgcgtcccgcgcgtggttttttttttttctcgtgagggacctcgcgccgccgggcgcgtgccgtccccctgcctcgcggcgcgggctctcgcgggccccgctcccgccctccgctcgcctggcccggaccggaagcggcgccgcacggcctgggcctggcgcggggggcgggctctggggcccggtcggacatgggcaagaagcacaagaagcacaagtcggaccgccacttctacgaggagtacgtggagaagcccctgaagctggtcctcaaagtcggggggagcgaggtcaccgagctctccacgggcagctccgggcacgactccagcctcttcgaagacagaagcgaccatgacaaacacaaggacagaaaacggaaaaagaggaagaaaggcgagaagcaggctccgggggaagagaaggggagaaaacggagaagagtcaaggaggataaaaagaagcgggatcgagaccgtgcagagaatgaggtggacagagatctccagtgtcatgtccctataagattagacttacctcctgagaagcctcttacaagctcgttagccaaacaagaagaagtagaacagacaccccttcaggaagctttgaatcagctcatgagacaattgcaaagaaaagacccaagtgctttcttttcatttcctgtgacggattttattgcgcctggctactccatgattattaaacacccaatggattttagtaccatgaaagaaaagatcaagaataacgactaccagtccatagaagaactaaaggataacttcaagctaatgtgtactaatgcaatgatttacaataagccagagaccatttattataaagctgcaaagaagctgttgcactcagggatgaaaattctcagtcaggagagaattcagagcctgaagcagagtatagacttcatgtcagacttgcagaaaactcggaagcagaaagaacgaacagatgcctgtcagagtggggaggacagcggctgctggcagcgcgagagggaagactctggagatgctgaaacacaggccttcagaagccccgctaaggacaataaaaggaaagacaaagatgtgcttgaagacaaatggagaagcagcaactcagaaagggagcatgagcagattgagcgcgttgtccaggagtcaggaggcaagctaacacggcggctggcaaacagtcagtgtgaatttgaaagaagaaaaccagatgggacaacaacactggggcttctccatcctgtggatcccattgtgggagagccaggctactgccctgtgagattggggatgacaactggaagactgcagtctggagtgaacactctgcaggggttcaaagaggataaaaggaacagagtaaccccagtattatacttgaattatggaccctacagttcttatgccccacattatgactctacatttgccaatattagcaaagatgattctgatttaatctactcaacatatggggaagactctgaccttccaaacaatttcagcatctctgagtttttggccacatgccaagattacccgtatgttatggcagatagtttactggatgttctaacaaaaggaggacattccaggagcctgcaggacttggacatgtcatctcctgaagatgaaggccagaccagagcattggacacagcaaaagaagcagagattacacaaatagagccaacagggcgtttggagtccagcagtcaggacaggctcacagcactgcaagctgtaacaacctttggtgctccagctgaagtctttgactccgaagaggctgaggtgttccagaggaagcttgatgagacgacaagattgctcagggagctccaggaggcacagaatgagcgactgagcactaggcctcctcccaatatgatctgtctcctgggtccttcttacagagaaatgtaccttgctgaacaagtgaccaataacctcaaagaactcacacagcaagtgactccaggtgatgttgtaagcatacacggagtgcgaaaagcaatggggatttctgttccttcccccatcgtgggaaacagcttcgtagatttgacaggagagtgtgaagaacctaaggagaccagcactgctgagtgtgggcctgacgcgagctgaactagcctggtatttgattctattatgtacatagtttttcattctgaacttggaggtgcttttcagaagatattaactatttgtaaattgtgttttaattaagctttgggacagttccttttaatgttccaaagattggccttgtattaggaaataaagctgaacctgggactgtga

SEQ ID NO: 18 - protein, 651 aa, Mus musculus
MGKKHKKHKSDRHFYEEYVEKPLKLVLKVGGSEVTELSTGSSGHDSSLFEDRSDHDKHKDRKRKKRKKGEKQAPGEEKGRKRRRVKEDKKKRDRDRAENEVDRDLQCHVPIRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMSDLQKTRKQKERTDACQSGEDSGCWQREREDSGDAETQAFRSPAKDNKRKDKDVLEDKWRSSNSEREHEQIERVVQESGGKLTRRLANSQCEFERRKPDGTTTLGLLHPVDPIVGEPGYCPVRLGMTTGRLQSGVNTLQGFKEDKRNRVTPVLYLNYGPYSSYAPHYDSTFANISKDDSDLIYSTYGEDSDLPNNFSISEFLATCQDYPYVMADSLLDVLTKGGHSRSLQDLDMSSPEDEGQTRALDTAKEAEITQIEPTGRLESSSQDRLTALQAVTTFGAPAEVFDSEEAEVFQRKLDETTRLLRELQEAQNERLSTRPPPNMICLLGPSYREMYLAEQVTNNLKELTQQVTPGDVVSIHGVRKAMGISVPSPIVGNSFVDLTGECEEPKETSTAECGPDAS

SEQ ID NO: 19 - DNA, 1692 bp, Homo sapiens
ggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaa

SEQ ID NO: 20 - protein, 498 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 21 - DNA, 1686 bp, Homo sapiens
ggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaa

SEQ ID NO: 22 - protein, 496 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 23 - DNA, 1665 bp, Mus musculus
gcggcggcggccgctgggactaggcgaaggcggcgacgacgacggaggcgcggggcgcttgggctgatggcagcggccgggcccggggcggcgctgtccccggggcggtgcgacagcgacccggcctcccccggagcgcagtccccaaaggatgataatgaagataactcaaatgatgggacccatccatgtaaaaggaggcgaatgggctcaggagacagctcaagaagttgtgagacttcaagtcaagatcttagcttcagttactacccagcagaaaacttaatcgaatacaaatggccacctgatgaaacaggagaatactatatgcttcaggagcaagtcagtgaatatctgggtgtgacctccttcaagcggaaatatccagatttagagcgacgagatttatctcacaaggagaaactatacctgagagaattaaacgtcatcacggaaacacagtgcacactgggtttaacagcattgcgcagtgatgaagtgattgacttaatgataaaagaatatccagctaaacacgctgaatattcggttatcctacaagaaaaggaacgtcagagaattacagatcattataaagagtattctcaaatgcaacaacagagtactcagaaagtcgaagccagcaaagtacctgagtacattaagaaagcagccaagaaggcagctgagttcaacagcaacttaaaccgggagcgcatggaagaaagaagagcctattttgacttacagacacatgttatccaagtgcctcaaggaaagtacaaagtgttgccgacagaccgaacgaaggtcagttcctacccagtggctctcatcccgggacagttccaggagtattataagaggtactcaccagatgagcttcggtacttgccattaaacacagccctgtatgagccgcccctggacccagagctcccggcactagatagtgatggagactcagatgatggcgaagatggcggaggggatgagaagcggaagaataaaggcacttcggacagctcctcaggcaatgtgtctgaaggagacagcccccctgacagccaggaggacaccttccacggaagacagaaatcaaaagacaaaatggccactccaagaaaagacggctccaaacgttctgtactgtccaaatcagctcctgggtacaagccaaaggtcattccaaatgctctatgtggaatttgtctgaagggtaaggagtccaacaagaaaggaaaggctgaatcacttatacactgctcccagtgtgataacagtggccacccttcttgcttggatatgaccatggagcttgtttctatgattaagacctacccatggcagtgtatggaatgtaagacatgcattatatgtggacagccccaccatgaagaagaaatgatgttctgtgatgtgtgtgacagaggttatcatactttttgtgtgggccttggtgctattccttcaggtcgctggatttgtgactgttgtcagcgagctcccccaacacccaggaaagtgggcagaagggggaaaaacagcaaagaggggtaaaataggctttgaccctcatgtttgggatatttggtgccaatttatttacaacactttcatttttatgccaataaaaacttttttgaaattaacgatgaccttaaa

SEQ ID NO: 24 - protein, 497 aa, Mus musculus
MAAAGPGAALSPGRCDSDPASPGAQSPKDDNEDNSNDGTHPCKRRRMGSGDSSRSCETSSQDLSFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQSTQKVEASKVPEYIKKAAKKAAEFNSNLNRERMEERRAYFDLQTHVIQVPQGKYKVLPTDRTKVSSYPVALIPGQFQEYYKRYSPDELRYLPLNTALYEPPLDPELPALDSDGDSDDGEDGGGDEKRKNKGTSDSSSGNVSEGDSPPDSQEDTFHGRQKSKDKMATPRKDGSKRSVLSKSAPGYKPKVIPNALCGICLKGKESNKKGKAESLIHCSQCDNSGHPSCLDMTMELVSMIKTYPWQCMECKTCIICGQPHHEEEMMFCDVCDRGYHTFCVGLGAIPSGRWICDCCQRAPPTPRKVGRRGKNSKEG

SEQ ID NO: 25 - DNA, 4206 bp, Homo sapiens
atgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttga

SEQ ID NO: 26 - protein, 1401 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 27 - DNA, 4275 bp, Mus musculus
atgaaatcctgcggagtgtcgctcgctaccgccgccgccgccgccgccgccgccgctttcggtgatgaggaaaagaaaatggcggcgggaaaagcgagcggcgagagcgaggaggcgtcccccagcctgacagcggaggagagggaggcgctcggcggactggacagccgccttttcgggttcgtgaggtttcatgaagatggcgccaggatgaaggccctgctgggcaaggctgttcgctgctacgaatctctaatcttaaaagctgaagggaaagtggagtctgatttcttttgtcaattaggtcacttcaacctcttattggaagattatccaaaagcattatctgcataccagaggtactacagtttacagtctgattactggaagaatgctgcctttttatatggtcttggtttggtctacttccattacaatgcatttcagtgggctattaaagcatttcaggaggtgctttatgtcgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcagtttcacattgcccacttatatgaaacccagaggaagtatcattctgcaaaagaagcttatgagcaacttttgcagacagaaaacctttctgcacaagtaaaagcaactattttacaacaattaggttggatgcatcacactgtggatctcctgggagataaggccaccaaggaaagttatgctattcagtatctccagaagtccttggaagcagatccaaattctggccagtcctggtatttccttggaaggtgctattcaagtattgggaaagttcaggatgcctttatatcttacaggcaatctattgataaatcagaagcaagtgcagatacatggtgttcaataggtgtgctctatcaacagcaaaatcagcctatggatgctttgcaagcttatatttgtgctgtacaattggaccacggtcatgctgcagcctggatggatctaggcactctctatgaatcctgcaaccaacctcaggatgctattaaatgctatttaaatgcaactagaagcaaaaattgtagtaatacctctggacttgcagcacgaattaagtatttacaggctcagttgtgtaaccttccacaaggtagtctacagaataaaactaaattacttcctagtattgaggaggcatggagcctaccaatccccgcagagcttacctccaggcagggtgccatgaacacagcacagcagaatacttctgataattggagtggtggcaatgcaccacctccagtagaacaacaaactcattcatggtgtttgacaccacagaaattacagcacttggaacagctccgagcaaacagaaataatttaaatccagcacagaaactaatgctggaacagctggaaagtcagtttgtcttaatgcagcaacaccaaatgagacaaacaggagttgcacaggtacggcctactggaattcttaatgggccaacagttgactcatcactgcctacaaactcagtttctggccagcagccacagcttcctctgaccagaatgcctagtgtctctcagcctggagtccacactgcctgtcctaggcagactttggccaatggacccttttctgcaggccatgttccctgtagcacatcaagaacactgggaagtacagacactgttttgataggcaataatcatgtaacaggaagtggaagtaatggaaacgtgccttacctgcagcgaaacgcacccactctacctcataaccgcacaaacctgaccagcagcacagaggagccgtggaaaaaccaactatctaactccactcaggggcttcacaaaggtccgagttcacatttggcaggtcctaatggtgaacgacctctatcttccactgggccttcccagcatctccaggcagctggctctggtattcagaatcagaatggacatcccaccctgcctagcaattcagtaacacagggggctgctctcaatcacctctcctctcacactgctacctcaggtggacaacaaggcattaccttaaccaaagagagcaagccttcaggaaacacattgacggtgcctgaaacaagcaggcaaactggagagacacctaacagcactgccagtgttgagggacttcctaatcatgtccatcaggtgatggcagatgctgtttgcagtcctagccatggagattctaagtcaccaggtttactaagttcagacaatcctcagctctctgccttgttgatgggaaaagctaataacaatgtgggtcctggaacctgtgacaaagtcaataacatccacccaactgtccatacaaagactgataattctgttgcctcttcaccatcttcagccatttccacagcaacaccttctcctaagtccactgaacagacaaccacaaacagtgttaccagccttaacagccctcacagtgggctgcacacaattaatggagaaggaatggaagaatctcagagccccattaaaacagatctgcttctagttagccacagacctagtcctcagatcataccatcaatgtctgtgtccatatatcccagctcagcagaagttctgaaagcttgcaggaatctaggtaaaaacggcctgtctaatagtagcattctgttggataaatgtccgcctccaagaccaccatcctcaccataccctcccttgccaaaggacaagttgaatccacctacacctagtatttatttggaaaataaacgtgatgctttctttcctccattacatcaattttgtacaaacccaaacaaccctgttacagtaatacgtggccttgctggagctcttaaattagacttgggacttttctctactaaaactttggtggaagctaacaatgaacatatggtagaagtgaggacacagttgttacaaccagcagatgaaaattgggaccctactggaaccaagaaaatctggcactgtgaaagtaatagatctcatactacaattgctaaatatgctcagtaccaggcctcctcattccaagaatcattgagagaagaaaatgagaaaagaagtcaccataaagaccactcagacagtgaatctacatcatcagataattctgggaaaagaagaaaaggaccctttaaaaccattaagtttgggaccaacattgacctgtctgatgacaaaaagtggaagttacagctacatgagctgactaaacttcctgccttcgtgagagttgtatctgcaggaaatcttttaagccacgttggtcatactatactgggcatgaacacagttcaactatacatgaaagttccaggaagcagaacaccaggtcatcaagaaaataacaacttctgttcagttaatataaatattggcccaggtgactgtgaatggtttgttgttcctgaaggctactggggtgttttgaatgacttctgtgaaaaaaataatttgaatttcttaatgggttcttggtggcccaaccttgaagatctatatgaagcaaatgttccagtgtataggtttattcagcgacctggagatctggtctggataaatgctggcactgttcattgggttcaagctattggctggtgcaacaatattgcttggaatgttggtccacttacagcctgtcagtataagttagcagtggaacgttatgaatggaacaagttgcaaaatgtaaagtcaatagtacccatggttcatctttcctggaatatggcacgaaatatcaaggtttcagatccaaagctttttgaaatgattaagtattgtcttctgagaacgctgaagcaatgtcagacattgagggaagctctaattgctgcaggaaaagagatcatatggcacgggcggacaaaagaagaaccagctcattattgtagtatttgtgaggtggaggtttttgatctgctttttgtcactaatgagagtaattctcgaaaaacctacatagtacattgccaagattgtgcacgaaaaacaagtgggaatctggaaaattttgtggtgctagaacagtacaaaatggaggatctgatgcaagtctatgaccaatttacattagtaagtgaaatcaacatgctcctccattaccatccgcctcatcttgatattgttccatggacattaaacatgagaccttttctgctattcagaaagtaa

SEQ ID NO: 28 - protein, 1424 aa, Mus musculus
MKSCGVSLATAAAAAAAAAFGDEEKKMAAGKASGESEEASPSLTAEEREALGGLDSRLFGFVRFHEDGARMKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATILQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKNCSNTSGLAARIKYLQAQLCNLPQGSLQNKTKLLPSIEEAWSLPIPAELTSRQGAMNTAQQNTSDNWSGGNAPPPVEQQTHSWCLTPQKLQHLEQLRANRNNLNPAQKLMLEQLESQFVLMQQHQMRQTGVAQVRPTGILNGPTVDSSLPTNSVSGQQPQLPLTRMPSVSQPGVHTACPRQTLANGPFSAGHVPCSTSRTLGSTDTVLIGNNHVTGSGSNGNVPYLQRNAPTLPHNRTNLTSSTEEPWKNQLSNSTQGLHKGPSSHLAGPNGERPLSSTGPSQHLQAAGSGIQNQNGHPTLPSNSVTQGAALNHLSSHTATSGGQQGITLTKESKPSGNTLTVPETSRQTGETPNSTASVEGLPNHVHQVMADAVCSPSHGDSKSPGLLSSDNPQLSALLMGKANNNVGPGTCDKVNNIHPTVHTKTDNSVASSPSSAISTATPSPKSTEQTTTNSVTSLNSPHSGLHTINGEGMEESQSPIKTDLLLVSHRPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGKRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQNVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLVSEINMLLHYHPPHLDIVPWTLNMRPFLLFRK

SEQ ID NO: 29 - DNA, 8585 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 30 - protein, 2285 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 31 - DNA, 7874 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 32 - protein, 2068 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 33 - DNA, 8175 bp, Mus musculus
atggccgcgcaggtcgcccccgccgccgccagcagcctgggcaacccgccgccgccgccctcggagctgaagaaagccgagcagcaacagcgggaggaggcggggggcgaggcggcggcggcagcggccgagcgcggggaaatgaaggcagccgccgggcaggagagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcccggagccgcccggcggcggcggcggcggcggcagcagcagcagcgacggggtgggggcgcctcctcactcggccgcggccgccctgccgcccccagcctacggcttcgggcaagcctacggccggagcccgtctgccgtcgccgccgcggcggccgccgtcttccaccaacaacatggcggacaacaaagccctggcctggcagcgctgcagagcggcggcggcgggggcttggagccctacgccgggccccagcagaactcgcacgaccacggcttccccaaccaccagtacaactcctactaccccaaccgcagcgcctaccccccgcctccccaggcctacgcgctgagctccccgagaggtggcactccgggctccggcgcggcggcggccgccggctccaagccgcctccctcctccagcgcctctgcctcctcgtcgtcttcgtccttcgcacagcagcgcttcggggccatggggggaggcggcccctcagcggccggcgggggaactccccagcccaccgccacccccaccctcaaccaactgctcacgtcgcccagctcggcccgtggctaccagggctaccccgggggcgactacggcggcgggccccaggacgggggcgcgggcaaaggcccggcggacatggcctcgcagtgctggggggctgcggcggcggcggcggcggcggcagcggccgtctcgggaggggcccaacaaaggagccaccacgcgcccatgagccccgggagcagcggcggcggggggcagccgctcgcccggacccctcagtcatccagtccaatggatcagatgggaaagatgagacctcagccgtatggtgggactaacccatactcgcaacaacagggacctccttcaggaccgcaacaaggacatgggtacccagggcagccatatgggtcccagactccacagcggtaccccatgaccatgcagggccgggctcagagtgccatgggcagcctctcttatgcacagcagattccaccttatggccagcaaggccccagtgcgtatggccagcagggccagactccatactataaccagcaaagtcctcatccccagcagcagccaccttacgcccagcaaccaccatcccagacccctcatgcccagccttcgtatcagcagcagccgcagactcagcaaccacagcttcagtcctctcagcctccatattcccagcagccatcccagcctccacatcagcagtccccaactccatatccctcccagcagtccaccacacaacagcatccccagagccagcccccctactcacaaccacaggcacagtctccctaccagcagcagcaacctcagcagccagcatcctcgtcgctctcccagcaggctgcatatcctcagccccagcctcagcagtcccagcaaactgcctattcccagcagcgcttccctccaccacaggagctttctcaagattcatttgggtctcaggcatcctcagccccctcaatgacctccagtaagggagggcaagaagatatgaacctgagtcttcagtcaaggccctccagcttgcctgatctgtctggttcaatcgatgatctccccatggggacagaaggagctctgagtcctggcgtgagcacatcagggatttccagcagccaaggagagcagagcaatccagctcagtctcccttttctcctcacacctcccctcacctgcctggcatccgaggcccgtccccgtcccctgttggctctcctgccagtgtcgcgcagtctcgctcaggaccactctcgcctgctgcagtgccaggcaaccagatgccacctcggccacccagtggccagtcagacagcatcatgcacccttccatgaaccaatcaagcattgcccaagatcgaggttatatgcagaggaacccccagatgccccagtacacttcccctcagcctggctcggccttatccccacgtcagccgtctggaggacagatgcactcgggcgtgggctcctaccagcagaactccatggggagctacggcccccagggcagtcagtatggcccacaaggaggctatcctaggcagcctaactataatgccttgcccaacgccaactaccccaatgcaggcatggccggaagtatgaaccctatgggtgctggaggtcagatgcatgggcagcctggaatcccaccttacggcacactccctccagggagaatggctcatgcgtctatgggcaacaggccctatggccctaatatggccaatatgccacctcaggttgggtcagggatgtgtcctccaccagggggaatgaacaggaaaactcaagagtctgctgttgccatgcatgttgctgccaactctatccaaaacaggccaccaggctacccaaatatgaatcaagggggcatgatgggaactggacctccctatggacaggggatcaatagtatggctggcatgatcaaccctcagggacccccatatcctatgggtggaaccatggccaacaattcagcagggatggcagccagcccagagatgatgggccttggggatgttaagttaactcccgccacaaaaatgaacaacaaggcagatggaacacccaagacagaatccaaatctaagaaatccagttcttctaccaccaccaatgagaagatcaccaaattgtatgagttgggtggtgagcccgagaggaagatgtgggtggaccggtacctggccttcacagaggagaaggccatgggcatgacaaatctgcctgctgtggggaggaagcctctggacctctatcgcctctatgtgtctgtgaaggagattggtgggttgactcaggtcaacaagaacaaaaaatggcgggaacttgcaaccaacctcaatgtgggtacatcaagcagtgctgccagctcactgaaaaagcagtatatccaatgtctctatgcctttgagtgcaagatcgagcgtggagaagaccctccccccgatatcttcgcagctgctgactccaagaagtcccaacccaagatccagcccccctctcctgcgggatcagggtctatgcaggggccacaaactcctcagtcaaccagcagttctatggcagaaggaggagacctgaagccaccaactccagcatccacaccacatagtcaaattccccccttaccaggcatgagcaggagcaactcagtcggaatccaggatgcctttcctgatggaagtgaccccacattccagaagcggaattccatgactccaaaccctgggtaccagcccagtatgaatacctctgacatgatggggcgcatgtcctatgagccaaataaggatccttatggcagcatgaggaaagcgccaggaagtgatcccttcatgtcctcagggcagggccccaatggcgggatgggtgatccctacagccgtgctgctggccctgggctgggaagtgtggcgatgggaccacggcagcactatccctatggaggtccttacgacagagtgaggacggagcctggaatcgggcctgaaggaaatatgggcactggagcccctcagccaaatctcatgccttccaccccagattcggggatgtattctcctagccgctaccccccgcagcagcagcagcaacagcagcaacaacatgattcctatggcaatcaattctctacccaaggcaccccttccagcagccccttccccagccagcagaccacaatgtatcagcagcagcagcagaattataagaggccaatggatggcacatatggcccccctgccaagcggcatgaaggggagatgtacagtgtgccgtacagcgctgggcaaggccagcctcaacagcagcagttgcctgcagctcagtcccagcctgccagccagccacaagctgcccagccttcccctcagcaggacgtgtacaaccagtacagcaatgcctaccctgcctccgccaccgctgctactgatcgccgaccagcaggcggcccccagaaccaatttccattccagtttggccgagaccgagtctctgcacctcctggttccagtgcccagcagaacatgccaccacaaatgatgggtggccccatacaggcatcagctgaggttgctcagcagggcaccatgtggcaggggcgaaatgacatgacctacaattatgccaacaggcagaacacaggctctgccacccagggccctgcgtatcatggtgtgaaccgaacagatgaaatgctccacacagatcagagggccaaccatgaaggcccatggccttcccatggcacacgccagcctccgtatggtccttcagcccctgttccccccatgacaaggccccctccatctaactaccagcccccaccaagcatgccgaatcacattcctcaggtatccagccccgctcccctcccccggcccatggagaaccgtacttctcctagcaagtctccattcctgcactctgggatgaaaatgcaaaaggcgggtccaccggtgcctgcttcgcacatagcgcctacccctgtgcagccgcctatgattcggcgggatatcaccttcccacctggctctgtagaggccactcagcctgtgttgaagcagagaaggcggctcacaatgaaagacattggaaccccggaggcatggcgggtaatgatgtccctcaagtccgggctcctggcagagagcacgtgggcgttagacaccattaacattctactgtatgatgacaacagcattatgaccttcaacctcagccagctcccaggcttgctagagctccttgtggaatatttccgtagatgcctaattgaaatctttggcattttaaaggagtatgaggtaggggacccaggacagagaacattactagaccctgggagattcaccaaggtgtatagtccagcccatacagaggaagaagaggaagaacaccttgatcctaaactggaggaggaagaggaagaaggggttggaaatgatgaggagatggcctttttgggcaaggacaagccatcttcagagaataatgaggagaagctagtcagtaagtttgacaagcttccggtaaagatcgtgcagaggaatgacccatttgtggtggactgctcagataagcttgggcgcgtgcaggagtttgacagtggcctgctacactggcggattggtggtggggataccactgagcatatccagacccactttgagagcaagatagagctgctgccttcccggccttatgtgccctgcccaacgccccctcggaaacacctcacaacagtagagggcacaccagggacaacggagcaggagggccccccgcccgatggccttccagagaaaaggatcacagccaccatggatgacatgttgtctacccggtctagcacattgactgatgagggggcaaagagtgcagaggccaccaaggaaagcagcaagtttccatttggcattagcccagcacagagccaccggaacatcaaaattttagaggatgaaccccatagtaaggatgagaccccactgtgtacccttctggactggcaggattcccttgctaagcgctgtgtctgtgtctccaataccatccggagcctgtcgtttgtgccaggcaacgactttgagatgtccaaacacccagggctgctgcttatcctgggcaagctgatcctgctgcaccacaagcacccagagcggaagcaggcaccactaacttatgagaaggaggaggaacaggaccaaggggtgagctgtgacaaagtggagtggtggtgggactgcttggagatgctccgagaaaacacgctggtcaccctcgccaacatctcggggcaattggacctatccccatatcctgagagcatctgcctgcctgtcctggacggactcctacactgggcagtttgcccttcagctgaagcccaggaccccttctcaaccctaggccccaatgccgtcctctccccccagagattggtcttggaaaccctcagcaaactcagcatccaggacaacaatgtggacctgatcctggccactcccccttttagccgcctggagaagttgtatagtaccatggtgcgcttcctcagtgaccgaaagaacccagtgtgccgggagatggccgtggtactgctggcaaatctggcccagggggacagcctggcagcccgggccattgcagtgcagaagggcagcatcggcaacctcctgggtttcctggaggacagccttgctgccacacagttccagcagagccaggcaagcctcctgcatatgcagaatccaccctttgaaccaactagtgtggacatgatgcggcgggctgcccgagcactgcttgccctggccaaggtggatgagaaccactcagagttcactctgtatgagtcacggctgttggacatctccgtgtcaccactgatgaactcattggtttcacaagtcatttgtgatgtactgtttttgattggccagtcatgacagccgtgggacacctcccctccccgtgtgtgtgtgagtgtgtggagaacttagaaactgactgttgccctttatttatgcaaaaccacctcagaatccagtttaccctgtgctgtccagcttctcccttgggaaagcctctcctgttctctctcctccccaccctcactccctcacacctttctgttccccatcctcacctgcttccctcaggaccccaccctatttgaaaagacaaagctctgcctacatagaagacttttttattttaaccaaagttactgttgtttacagtgagtttggggaaaaaaatggctttcccagtccttgcatcaacgggatgccacatttcataactgtttttaatggttaaaaaaaaaaaaaaaaaaaggaaaaaaaatacaaaaaaaccctgaaggacaaaggtgactgctgagctgtgtggtttgtcgctgtccattcacaatctcgcaggagccgagaagttcgcagttgtgagcagaccctgttcactggagaggcctgtgcagtagagtgtagatcctttcatgtactgtactgtacacctgatactgtaaacatactgtaataataatgtctcacatggaaacgagagaagacgctgggtcagcagcaagctgtagtttttaaaaatgtttttagttaaatgttgaggagaaaaaaaatggctttccccccaaagtatcctgtgtgaacctacaacgccctgacctctttctctcctccttgattgtatgaatagccctgagatcacctcttagacctggttttaacctttagctgcagcggctgcgctgccacgtgtgtatatatatgatgttgtacattgcacatacccttgaatctccacagtttggtccccttcccagctacccctttatagtatggcgagttaacaagttggtgacctgcacaaagcgagacacagctatttaatctcttgccagacattgcccctcttggtgcagtgctctacaggtctctgtaaaaagcccttgctgtctcagcagccaatcaacttacagtttatttttttctgggtttttgttttgttttgtttcatttctaatcgaggtgtgaaaaagttctaggttcagttgaagttcctgatgaagaaacacaattgagattttttcagtgataaaatctgcatatttgtatttcaacaatgtagctaaaaacttgatgtaaattcctccttttttttccttttttggcttaatgaatatcatttattcagtatgaaatctttatactatatgttccacgtgttaagaataaatgtacattaaatcttggtaa

SEQ ID NO: 34 - protein, 2283 aa, Mus musculus
MAAQVAPAAASSLGNPPPPPSELKKAEQQQREEAGGEAAAAAAERGEMKAAAGQESEGPAVGPPQPLGKELQDGAESNGGGGGGGAGSGGGPGAEPDLKNSNGNAGPRPALNNNLPEPPGGGGGGGSSSSDGVGAPPHSAAAALPPPAYGFGQAYGRSPSAVAAAAAAVFHQQHGGQQSPGLAALQSGGGGGLEPYAGPQQNSHDHGFPNHQYNSYYPNRSAYPPPPQAYALSSPRGGTPGSGAAAAAGSKPPPSSSASASSSSSSFAQQRFGAMGGGGPSAAGGGTPQPTATPTLNQLLTSPSSARGYQGYPGGDYGGGPQDGGAGKGPADMASQCWGAAAAAAAAAAAVSGGAQQRSHHAPMSPGSSGGGGQPLARTPQSSSPMDQMGKMRPQPYGGTNPYSQQQGPPSGPQQGHGYPGQPYGSQTPQRYPMTMQGRAQSAMGSLSYAQQIPPYGQQGPSAYGQQGQTPYYNQQSPHPQQQPPYAQQPPSQTPHAQPSYQQQPQTQQPQLQSSQPPYSQQPSQPPHQQSPTPYPSQQSTTQQHPQSQPPYSQPQAQSPYQQQQPQQPASSSLSQQAAYPQPQPQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYTSPQPGSALSPRQPSGGQMHSGVGSYQQNSMGSYGPQGSQYGPQGGYPRQPNYNALPNANYPNAGMAGSMNPMGAGGQMHGQPGIPPYGTLPPGRMAHASMGNRPYGPNMANMPPQVGSGMCPPPGGMNRKTQESAVAMHVAANSIQNRPPGYPNMNQGGMMGTGPPYGQGINSMAGMINPQGPPYPMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFPDGSDPTFQKRNSMTPNPGYQPSMNTSDMMGRMSYEPNKDPYGSMRKAPGSDPFMSSGQGPNGGMGDPYSRAAGPGLGSVAMGPRQHYPYGGPYDRVRTEPGIGPEGNMGTGAPQPNLMPSTPDSGMYSPSRYPPQQQQQQQQQHDSYGNQFSTQGTPSSSPFPSQQTTMYQQQQQNYKRPMDGTYGPPAKRHEGEMYSVPYSAGQGQPQQQQLPAAQSQPASQPQAAQPSPQQDVYNQYSNAYPASATAATDRRPAGGPQNQFPFQFGRDRVSAPPGSSAQQNMPPQMMGGPIQASAEVAQQGTMWQGRNDMTYNYANRQNTGSATQGPAYHGVNRTDEMLHTDQRANHEGPWPSHGTRQPPYGPSAPVPPMTRPPPSNYQPPPSMPNHIPQVSSPAPLPRPMENRTSPSKSPFLHSGMKMQKAGPPVPASHIAPTPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFTKVYSPAHTEEEEEEHLDPKLEEEEEEGVGNDEEMAFLGKDKPSSENNEEKLVSKFDKLPVKIVQRNDPFVVDCSDKLGRVQEFDSGLLHWRIGGGDTTEHIQTHFESKIELLPSRPYVPCPTPPRKHLTTVEGTPGTTEQEGPPPDGLPEKRITATMDDMLSTRSSTLTDEGAKSAEATKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCDKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 35 - DNA, 9609 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaaaaaaaaaaaa

SEQ ID NO: 36 - protein, 2236 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 37 - DNA, 9648 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggactctggagatgccacatggaaagaaacattctggttgatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaaaaaaaaaaaa

SEQ ID NO: 38 - protein, 2249 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 39 - DNA, 9833 bp, Homo sapiens
gggggcggcggcgacggcggcggcggcctgaacagtgtgcaccaccaccccctgctcccccgtcacgaactcaacatggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaa

SEQ ID NO: 40 - protein, 2289 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 41 - DNA, 11325 bp, Mus musculus
tcggcgggccccggctcgaccatggagaccgggctgctccccaaccacaaactgaaagccgttggcgaggcccccgctgcaccgccccatcagcagcaccaccaccaccatgcccaccaccaccaccaccaccatgcccaccacctccaccacctccaccaccaccacgcactacagcagcagctaaaccagttccagcagccgcagccgccgcagccacagcagcagcagccgccgccaccgccgcagcagcagcatcccactgccaacaacagcctgggcggtgcgggcggcggcgcgcctcagcccggcccggacatggagcagccgcaacatggaggcgccaaggacagtgtcgcgggcaatcaggctgacccgcagggccagcctctgctgagcaaaccgggcgacgaggacgacgcgccgcccaagatgggggagccggcgggcagccgctatgagcacccgggcctgggcgcgcagcagcagcccgcgccggtcgccgtgcccgggggcggcggcggcccagcggccgtctcggagtttaataattactatggcagcgctgcccctgctagcggcggccccggcggccgcgctgggccttgctttgatcaacatggcggacaacaaagccccgggatggggatgatgcactccgcctctgccgccgccggggcccccagcagcatggaccccctgcagaactcccacgaagggtaccccaacagccagtacaaccattatccgggctacagccggcccggcgcgggcggcggcggcggcggcggcggaggaggaggaggcagcggaggaggtggaggaggaggaggagcaggaggagcaggaggagcagcggcagcggcagcaggagccggagctgtggcggcggcggccgcggcggcggcggcagcagcagcagcagcaggaggaggcggtggcggcggctatgggagctcgtcctcggggtacggggtgctgagctccccgcggcagcagggcggcggcatgatgatgggccccgggggcggcggggccgcgagcctcagcaaggcggccgccggcgcggcggcggcggcggggggcttccagcgcttcgccggccagaaccagcacccgtcgggggctacaccgaccctcaaccagctgctcacctcacccagccccatgatgaggagctacggcggtagctaccccgactacagcagctccagcgcgccgccgccgccgtcgcagccccagtcccaggcggcggcgggggcggcggcgggtggccagcaggcggccgcgggcatgggcttgggcaaggacctaggcgcccagtacgccgctgccagcccggcctgggcggccgcgcaacaaaggagtcacccggcgatgagccccggcacccccggaccgaccatgggcagatcccagggcagcccgatggacccaatggtgatgaagagacctcagttgtatgggatgggtactcacccccactcccagccacagcagagcagcccatacccaggaggctcctacggtcccccaggtgcacagcggtatccccttggcatgcagggccgggctccaggggccctgggaggcttgcagtacccgcagcagcagatgccaccgcagtacggacagcaagctgtgagtggctactgccagcaaggccagcagccatactacaaccagcagccgcagccctcgcacctcccgccccaggcacagtacctgcagccggcggcggcgcagtcccagcagaggtaccagccacagcaggacatgtctcaagaaggctatggaactagatctcagcctcctctggcccctggaaaatccaaccatgaagacttgaatttaattcaacaggaaagaccatcgagtctaccagacctgtctggctccatcgatgacctccccacgggaacagaagcaactctgagctcagcagtcagtgcatccgggtctacaagcagccagggagatcagagcaacccagcgcagtctcctttctccccacatgcatcacctcacctctccagcatccctggagggccgtcaccttctcctgttggctctcctgtgggaagcaaccaatcgaggtctggtccgatctcccctgcgagtattccaggtagccagatgcctccgcaaccacctggaagccagtcagaatccagttcccatcctgccttgagccagtcaccaatgccacaggaaagaggttttatgacaggcactcagagaaaccctcagatgtctcagtacggacctcagcagacaggaccatccatgtcgcctcacccatctcctgggggccagatgcatcctgggatcagtaactttcagcagagtaactcaagtggcacgtacggcccacagatgagccagtatggaccccaaggcaactactccagaaccccaacatatagcggggtacccagtgcaagctacagcggcccagggcccggtatgggcatcaatgccaacaaccagatgcatggacaagggccagcccagccatgtggtgctatgcccctgggacgaatgccttcagctgggatgcagaacagaccatttcctggaaccatgagcagcgtcacccccagttctcctggcatgtctcaacagggagggccaggaatgggcccaccaatgcccactgtgaaccggaaggcccaggaagctgccgcagctgtgatgcaggctgctgcaaactcagcacaaagcaggcaaggcagttttcctggcatgaaccagagtggcctggtggcctccagctctccctacagccagtccatgaacaacaactccagcctgatgagcacccaggcccagccctacagcatgacgcccacaatggtgaacagctccacagcatctatgggtcttgcagatatgatgtctcccagtgagtccaaattgtctgtgcctcttaaagcagatggtaaagaagaaggcgtgtcccagcctgagagcaagtcaaaggacagctatggctctcagggcatttcccagcctccaaccccaggcaacctgcctgtcccttccccaatgtctcccagctctgccagcatctcctcctttcatggagatgagagtgacagcattagcagcccaggctggcccaagacaccatcaagccctaagtccagctcttcctccaccactggggagaagatcacgaaggtctatgagctggggaatgagccggagaggaagctgtgggtcgaccgttacctaacgttcatggaagagaggggctccccggtgtccagtctgccagcagtgggcaagaagcccctggacctgttccgactgtatgtctgcgtcaaggagattggaggtttggcgcaggttaataaaaacaagaagtggcgtgagctggcaaccaacctgaacgttggcacttccagcagcgcagccagctctctgaaaaagcagtatattcagtacctgttcgcctttgagtgcaaaactgagcgcggggaggagcccccacctgaagtcttcagcaccggggattcgaagaagcagccaaagctccagccgccatctcctgctaactcaggatccttacaaggcccacagactccacagtcaactgggagcaattcgatggcagaggttccaggtgacctgaagccaccaaccccagcctctacccctcatggacagatgactcccatgcaaagcggaagaagcagtacagtcagtgtgcatgacccgttctcagacgtgagtgactcagcgtacccaaaacggaactccatgactccaaacgccccataccagcagggcatgggcatgccagacatgatgggcaggatgccctatgaacccaacaaggaccctttcagtggaatgagaaaagtgcctggaagtagtgagccctttatgacacaaggacaggtgcccaacagcggcatgcaggacatgtacaaccagagcccctcaggggccatgtccaatctgggcatgggacagcggcagcagtttccctatggaaccagttatgaccgaaggcatgaggcttacggacagcagtacccaggccaaggccctcccacaggacagccaccgtatggaggacaccagcctggcctgtacccacagcagccgaattacaaacgtcatatggatggcatgtacgggcctccagccaagcggcacgagggagacatgtacaacatgcagtatggcagccagcagcaggagatgtataaccagtatggaggctcctactctggcccggacagaaggcccatccagggacaatatccctacccctacaacagagaaaggatgcagggcccaggccagatgcagccacacggaatcccacctcagatgatggggggccccatgcagtcatcctccagcgaggggcctcagcagaacatgtgggctacacgcaacgatatgccttatccctaccagagcaggcaaggcccgggcggccctgcacaggcccccccttacccaggcatgaaccgcacagatgatatgatggtacctgagcagaggatcaatcacgagagccagtggccttctcacgtcagccagcgccagccttacatgtcatcttcggcctccatgcagcccatcacgcgcccacctcagtcatcctaccagacgccgccgtcactgccaaaccacatctccagggcacccagccccgcctccttccagcgctccctggagagtcgcatgtctccaagcaagtctcccttcctgcccaccatgaagatgcagaaggtcatgcccacagtccccacatcccaggtcaccgggccccccccacagcctccaccaatcagaagggagattacctttcctcctggctccgtagaagcatcacagccaatcctgaaacaaaggcgaaagattacctcaaaagatattgttactcccgaggcgtggcgtgtgatgatgtcccttaaatcgggtctgttggctgagagcacgtgggctctggacaccatcaatattctcctctatgatgacagcaccgtcgccaccttcaatctttcccagctgtctggattcctggaactattagtagagtactttcgaaaatgcctaattgacattttcggaattcttatggaatatgaagtgggtgaccccagccaaaaggctcttgatcaccgttcagggaagaaagatgacagccagtccctggaagatgattctgggaaggaagacgatgatgctgagtgtcttgtggaagaggaggaggaggaagaggaggaggaggaagacagtgaaaagatagagtcagaggggaagagcagccctgccctagctgctccagatgcctccgtggaccccaaggagacgccaaagcaggccagtaagtttgacaagctgcccataaagattgtcaaaaagaacaagctgtttgtggtggaccggtccgacaagctgggccgagtgcaggagttcagcagcgggctcctccactggcagctgggtggtggcgacactaccgagcacatccagactcacttcgagagcaagatggagatccctcctcgcaggcgtccacctccgcctctaagctccacgggtaagaagaaagagctggaaggcaaaggtgattctgaagagcagccagagaaaagtatcatagccaccatcgatgacgtcttgtctgcccggccaggggctctgcctgaagacaccaacccaggaccccagaccgacagcggcaagtttccctttggaatccagcaggccaaaagccaccggaacatcaggctcctggaagacgagcccaggagccgagacgagacgccgctgtgcaccatcgcgcactggcaggactcactggccaagcgctgcatctgtgtgtcgaacatcgtgcggagcttgtctttcgtgcctggcaacgacgcagagatgtccaaacacccgggcttggtgctgatcctgggaaagctgattctgctgcatcacgagcatccggagagaaagcgggcgccacagacctatgagaaggaggaggacgaggacaagggggtggcctgcagcaaagatgagtggtggtgggactgcctcgaggtcttgcgggataacaccctggtcacgttggcgaacatttccgggcagctagacttgtctgcttacacagagagcatctgcttgccgatcctggacggcttgctacactggatggtgtgcccgtccgcagaggctcaggacccctttcccactgtggggcccaactcagtcctgtcgccgcagagacttgtgctggagaccctgtgtaaactcagtatccaggacaacaacgtggacctgatcttggccacgcctccatttagtcgtcaggagaaattttatgctacattagttaggtacgttggggatcgcaaaaatccagtctgtcgagaaatgtccatggcgcttttatcgaaccttgcccagggggacacactggcggcgagggcaatagctgtgcagaaaggaagcattggtaacttgataagcttcctagaggacggggtgacgatggcgcagtaccagcagagccagcataaccttatgcacatgcagcccccacctctggaaccccctagtgtagacatgatgtgccgggcggccaaagctctgctggccatggccagagtggacgagaaccgctcggagttccttttgcacgagggtcggttgctggatatctcaatatcagctgtcctgaactctctggttgcatctgtcatctgtgatgtactgtttcagattgggcagttatgacatccgtgaaggcacacatgtgtgagtgaacattagagggtcacatataactggctgttttctgttctcgtttatccagtgtaagaagaaggaaaagaaaaatctttgctcctctgccccgtttactatttaccaattgggaattaaatcattaatttgaacagttataaaattaatatttgctgtctgtgtgtataagtacatcctctggcggttttctgtttcttttttttttaaccaaagttgccgtctagtgcattcaaaggtcacaatttttgtttgtttgtttgtttgtttgttttttcataatttttttcatgttgtattgcagtctttgggaagtgaattgactttataaagaaaaacgttttggcaaaaagtgctaagatagaaaaatgtcaccacactgggtcaaaaacgtgaaaggaaaaattgattcttaaattgatttcctatgaattttattcttcacagaatgataaaagctaaactgcaccccgtcacccaaagctctgtgcaatagaaacttctagagatatagtgtaggggctgaaggaggtatggcagcagtagtcagggtcaatgatactgctttctccaccggaaagtggttacgttaggcctcgagcaaaaaacagcgctctcagataggtgcaaaaatccactcctagcagccaacagcaggatcgcttcctcaccacgaccgccatgtctgctgtggctcagcctccacgggacaaagcttcaagatttctttcatcatttttttaaatattttttttactgcctatgggctgtgatgtatatagaagttgtacattaaacataccctcatttttttcttcttttctttttttctttttttctttttctttttttttttttttagtacaaagtttttagtttctttttcatgatgtggtaactacgaagtgatggtagatttaaataattttttatttttattttatatattttttcattaggaccatatctccaaaaaacaagaaaaagaaacaaaaaatacaaaaaataaaaacaaacaaaaaaagagggtaatgtacaagtttctgtatgtataaagtcatgctctgttgggagagcggctgatcccagtttgcttcatgaatcaaagtgtggaaatggttgcatacagattgatttagaaaatggacaccagtacatacaaaaaaagaaaaaagaaagaaaaccaactaaatggaagaaacacaacttcaaagatttttctgtgacaagaatccacatttgtatttcaagataatgtagtttaagaaaagaaaaaaaagaaaaaaaaagaaaaaaacttgatgtaaattcctccttttcctctggcttaatgaatatcatttattcagtataaaatctttatatgtcccacatgttaagaataaatgtacattaaatcttgttacgcactgtgatgggtgttcttgaatgctgttctagtttgcctagcatggttgccatagtaaccaagttatttacaggaaatagggaagatgtaacaactgcttcctggtaatgatgcccaaaggccagaagggactttcagggtttcctacttgagagtgggagcaacaatttgattttctcagattgtttagctaattaggtcttctttgaagcaattaactctggtgacattgagaagtggtaattccctcatggatgggtggtggctgccaacccactgtgacatggggccctgcaagctaactggcctgaaaccacgaccttctgcctctcactactgatttaacccaagtctgcacccgtcatgtttcttctgtgtgcctccaagttactctgcgttagtttgctccagcgtgtataatatttatattgtgcaatgttaaagagaacgtgtcatattgtatgccgtgtgtatagtgccaagtgatgattctgtttcagagcataccttccttcctgcccagtccctggctctctaataccccaccctgatggaaagtgcttcttcctgggtaattgactgttactgtgtaacgctcagtctcattgaaacttacataaccatgctgctggtgccccttcctaccctacctctctcagcactcttcagttgacacttcccacacctgtcactgtggcccaccttgctcacgctgacatctggaagagttagacaggagcacacacttacaacactaggagatgttattctggtgtcacgagaaagaaattggtttttcctgcaaacagtcccatcaccaagcagcccccacatcaggtcagcaaaaagatctgtgttgaatcaaaactccatttataattctactagatgggaatacatctgcttacaaaggacagattttagtgttctgtgatgaaaatatggagagtgcaagagagagttcaatggaatcctaatcttgctcttgcagacaatgaatgaaaggtatagacaggctcagttccctgtcagaagagtggtctcaaagacaagtggctgtatagcagccaggcccagaacagcctcgcagcacacactaacaccaagcgggtgtctgagctctcctaggaagccttgtgcctgccctccctccattcacccagatccgactcctggaagcccacgaaagagtcaccctttgcttcacatttcctgacgataccgagttgctgctctgtcctaaaaatattagttcttttccagggctttcagaaatttgcaggatgcccatactctaaatgtgtaccaaaaagagagagaaataaaggtgcgaagaaagtttagtattttggaatggtgcgataaaatggaatctgttggtttttaatgtaacataagatactattggctggcactggctaaaaaaaatatctaagtgttggagttggatgcacaatcaacttttacttagctattcaaagagtacttatgttttccaagttaaaacagacttgtttttgacaggggccgtgggtggtcttatacaatgccagctcctaactgcagcttctgagaactggatatcgtttgccctgagagctgcccgtctccaactatgtgctgctgctgccctgtgtgctcagcccacaaggatgtggagactggatagacaaccccttgcttcttgctgggttgtgctgagttctttgcagtccagtcaagtgcccagagctaccagcctacgtccctcatgcatccaagagaaatgatcttgactatcatgatcaaaacagctgtagtaatatttctagtaaatatttctgatgactctgtgtaatctcctacaacaggacactattcattaacttgacagagacatgtgggcatgtggtcctgctttagtttaacagacaagtcaaccagttctcattacttaggaagagtgaggctatgtctgttacaatcccaatgtggtgcttgcccttatccaaagacagtccgggggccctgtctgcctgaactatgtctcgctccctcttgggcttcccactgggatgtgaaaagataaccaatggctcccaggttcccagtgccccccaaaccagtaatcaggtctgggactacagaacccgcaaaatcatacacaggctgtttcaaagccagtactctctttatactcctgcttcctccagcccccatttcacaccccacccaaatcacaaggtcctctgaagtctcagaactccaaattaacgttgggatttacgatgtgaatgctgaggagaaaattgggagttggtgggagatcaccaaattgtcaaaactatgaaactcatctgtcttcccaaatctgacctcagggacttggggggttcactctggcttctgccacagtattttctggggaaccaaaggcctcgggaatagagaaacaggttgccggatatcctggaagtctaagccatactgaccagtttgtcttgagtgttttctttgtgagcctggaactgtccccggacccctttcttttaaacatggttcaggactttaaaaaaaagcactgtattttttttatgtaagccaagatgccctccctagcagagatagcgttgaactgtctctagttctgtagcctgagagacttaaatcgtttaacttcagtgtctttgtccactctgttgaactgctaaggattctattgaatgtgttctttgcggctttggaggagttgctgggtgtgtaagtcctgcatccctttgcctggtatgtgtatattattcctttgcctggctgtgtatcgttcttcagtgtaagtacacccacactctgtattcctttgcctgctccccgcccccccacacacacacatcctgcatagttttaaaataaggcctgagagactgtttctatttcctgtcatagctggtgacttttaacagttgaggcgaatggcctgtcacttgcctgggttcccgtcaggggtgatccatggaactcctcagtggaacagaatttaggacagaagatcccaccttccttccaggcctggggagaatcagactgtgagataaaccatgatgctgcccaatcccactgccccaccttgcttttaaaataaagtgcctcctaacgtc

SEQ ID NO: 42 - protein, 2244 aa, Mus musculus
METGLLPNHKLKAVGEAPAAPPHQQHHHHHAHHHHHHHAHHLHHLHHHHALQQQLNQFQQPQPPQPQQQQPPPPPQQQHPTANNSLGGAGGGAPQPGPDMEQPQHGGAKDSVAGNQADPQGQPLLSKPGDEDDAPPKMGEPAGSRYEHPGLGAQQQPAPVAVPGGGGGPAAVSEFNNYYGSAAPASGGPGGRAGPCFDQHGGQQSPGMGMMHSASAAAGAPSSMDPLQNSHEGYPNSQYNHYPGYSRPGAGGGGGGGGGGGGSGGGGGGGGAGGAGGAAAAAAGAGAVAAAAAAAAAAAAAAGGGGGGGYGSSSSGYGVLSSPRQQGGGMMMGPGGGGAASLSKAAAGAAAAAGGFQRFAGQNQHPSGATPTLNQLLTSPSPMMRSYGGSYPDYSSSSAPPPPSQPQSQAAAGAAAGGQQAAAGMGLGKDLGAQYAAASPAWAAAQQRSHPAMSPGTPGPTMGRSQGSPMDPMVMKRPQLYGMGTHPHSQPQQSSPYPGGSYGPPGAQRYPLGMQGRAPGALGGLQYPQQQMPPQYGQQAVSGYCQQGQQPYYNQQPQPSHLPPQAQYLQPAAAQSQQRYQPQQDMSQEGYGTRSQPPLAPGKSNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMTGTQRNPQMSQYGPQQTGPSMSPHPSPGGQMHPGISNFQQSNSSGTYGPQMSQYGPQGNYSRTPTYSGVPSASYSGPGPGMGINANNQMHGQGPAQPCGAMPLGRMPSAGMQNRPFPGTMSSVTPSSPGMSQQGGPGMGPPMPTVNRKAQEAAAAVMQAAANSAQSRQGSFPGMNQSGLVASSSPYSQSMNNNSSLMSTQAQPYSMTPTMVNSSTASMGLADMMSPSESKLSVPLKADGKEEGVSQPESKSKDSYGSQGISQPPTPGNLPVPSPMSPSSASISSFHGDESDSISSPGWPKTPSSPKSSSSSTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKTERGEEPPPEVFSTGDSKKQPKLQPPSPANSGSLQGPQTPQSTGSNSMAEVPGDLKPPTPASTPHGQMTPMQSGRSSTVSVHDPFSDVSDSAYPKRNSMTPNAPYQQGMGMPDMMGRMPYEPNKDPFSGMRKVPGSSEPFMTQGQVPNSGMQDMYNQSPSGAMSNLGMGQRQQFPYGTSYDRRHEAYGQQYPGQGPPTGQPPYGGHQPGLYPQQPNYKRHMDGMYGPPAKRHEGDMYNMQYGSQQQEMYNQYGGSYSGPDRRPIQGQYPYPYNRERMQGPGQMQPHGIPPQMMGGPMQSSSSEGPQQNMWATRNDMPYPYQSRQGPGGPAQAPPYPGMNRTDDMMVPEQRINHESQWPSHVSQRQPYMSSSASMQPITRPPQSSYQTPPSLPNHISRAPSPASFQRSLESRMSPSKSPFLPTMKMQKVMPTVPTSQVTGPPPQPPPIRREITFPPGSVEASQPILKQRRKITSKDIVTPEAWRVMMSLKSGLLAESTWALDTINILLYDDSTVATFNLSQLSGFLELLVEYFRKCLIDIFGILMEYEVGDPSQKALDHRSGKKDDSQSLEDDSGKEDDDAECLVEEEEEEEEEEEDSEKIESEGKSSPALAAPDASVDPKETPKQASKFDKLPIKIVKKNKLFVVDRSDKLGRVQEFSSGLLHWQLGGGDTTEHIQTHFESKMEIPPRRRPPPPLSSTGKKKELEGKGDSEEQPEKSIIATIDDVLSARPGALPEDTNPGPQTDSGKFPFGIQQAKSHRNIRLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDTLAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 43 - DNA, 5024 bp, Homo sapiens
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 44 - protein, 1406 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 45 - DNA, 4688 bp, Homo sapiens
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 46 - protein, 1294 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 47 - DNA, 5082 bp, Homo sapiens
atgtgcgcgcacgccgctttacgcatgctccttaagttccccgtactccctcggagaccctagctacacgccgaatccgttactccgggttttcgcagtggctcggtggcctaccccgatcgaaacctagtctggaactgaacctacaatatctctgagggaggacacatctatgactagcagtggcatgtgctcaggaaagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagaggcagaccaatgtgggaagggcactcactgagttgggatccagaggacctaagtaccaagtttcactgtttcgcttctgtgtaggatcttgggcaactggaaacaccttctttttatcatctataaaaccaggatccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 48 - protein, 1382 aa, Homo sapiens
MKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKRQTNVGRALTELGSRGPKYQVSLFRFCVGSWATGNTFFLSSIKPGSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 49 - DNA, 3416 bp, Homo sapiens
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgcaaaaaaaaaaaaaaaaaaa

SEQ ID NO: 50 - protein, 870 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLRGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 51 - DNA, 4702 bp, Mus musculus
gaagtgctttctgattctctgtctgtggaggagccctgggaggggtgggacagagatggcatcctggctctctgaggcacctgctcttctctgaaccacacaggagtcaagagccaaacagggatagcttcagcagcacttcagagggtgttctctaagtaagaacatgaagctcaagagaactgcctaccttctcttcctgtacctcagctcctcactgctcatctgcataaagaattcattttgcaataaaaacaataccaggtgcctttcaggtccttgccaaaacaattctacgtgcaagcattttccacaagacaacaattgttgcttagacacagccaataatttggacaaagactgtgaagatctgaaagacccttgcttctcgagtccctgccaaggaattgccacttgtgtgaaaatcccaggggaagggaacttcctgtgtcagtgtcctcctgggtacagcgggctgaactgtgaaactgccaccaattcctgtggagggaacctctgccaacatggaggcacctgccgtaaagaccctgagcaccctgtctgtatctgccctcctggatatgctggaaggttctgtgagactgatcacaatgagtgtgcttctagcccttgccacaatggggctatgtgccaggatggaatcaatggctactcctgcttctgtgtgcctggataccaaggcaggcattgtgacttggaagtggatgaatgtgtttctgatccctgcaagaatgaggctgtgtgcctcaatgagataggaagatacacttgtgtctgccctcaagagttttctggcgtgaactgtgagttggaaattgatgaatgcagatcccagccttgtctccacggtgccacatgtcaggacgctccagggggctactcctgtgactgtgcacctggattccttggagagcactgtgaactcagcgttaatgaatgtgaaagtcagccgtgtctccatggaggtctatgtgtggatggaagaaacagttaccactgtgactgcacaggtagtggattcacagggatgcactgtgagtccttgattcctctttgttggtcaaagccttgtcacaacgacgcgacatgtgaagatactgttgacagctatatttgtcactgccggcctggatacacaggtgccctgtgtgagacagacataaatgaatgcagtagcaacccctgccaattttggggggaatgtgtcgagctgtcctcagagggtctatatggaaacactgctggcctgccttcctccttcagctatgttggagcctcgggctatgtgtgtatctgtcagcctggattcacaggaattcactgtgaagaagacgttgatgaatgtttactgcacccttgcctaaatggtggtacttgtgagaacctgcctgggaattatgcctgtcactgtccctttgatgacacttctaggacattttatggaggagaaaactgctcagaaattctcctgggctgcactcatcaccagtgtctgaacaatggaaaatgtatccctcatttccaaaatggccagcatggattcacttgccagtgtctttctggctatgcggggcccctgtgtgaaactgtcaccacactttcatttgggagcaatggcttcctatgggtcacaagtggctcccatacaggcatagggccagaatgtaacatatccttgaggtttcacactgttcaaccaaacgcacttctcctcatccgaggcaacaaggacgtgtctatgaagctggagttgctgaatggttgtgttcacttatcaattgaagtctggaatcagttaaaggtgctcctgtctatttctcacaacaccagtgatggagaatggcatttcgtggaggtaacaatcgcagaaactctaacccttgccctagttggcggctcctgcaaggagaagtgcaccaccaagtcttctgttccagttgagaatcatcaatcaatatgtgctttgcaggactcttttttgggtggcttaccaatggggacagccaacaacagtgtgtctgtgcttaacatctataatgtgccgtccacaccttcctttgtaggctgtctccaagacattagatttgatttgaatcacattactctggagaacgtttcatctggcctgtcatcaaatgttaaagcaggctgcctgggaaaggactggtgtgaaagtcaaccctgtcaaaacagaggacgctgcatcaacttgtggcagggttatcagtgtgaatgtgacaggccctatacaggctccaactgcctgaaagagtatgtagcgggaagatttggccaagatgactccacaggatatgcggcctttagtgttaatgataattatggacagaacttcagtctttcaatgtttgtccgaacacgtcaacccctgggcttacttctggctttggaaaatagtacttaccagtatgtcagtgtctggctagagcacggcagcctagcactgcagactccaggctctcccaagttcatggtaaacttttttctcagtgatggaaatgttcacttaatatctttgagaatcaaaccaaatgaaattgaactgtatcagtcttcacaaaacctaggattcatttctgttcctacatggacaattcgaagaggagacgtcatcttcattggtggcttacctgacagagagaagactgaagtttatggtggcttcttcaaaggctgtgttcaagatgtcagattaaacagccagactctggaattctttcccaattcaacaaacaatgcatacgatgacccaattcttgtcaatgtgactcaaggctgtcccggagacaacacatgtaagtccaacccctgtcataatggaggtgtctgccactccctgtgggatgacttctcctgctcctgccctacaaacacagcggggagagcctgcgagcaagttcagtggtgtcaactcagcccatgtcctcccactgcagagtgccagctgctccctcaagggtttgaatgtatcgcaaacgctgttttcagcggattaagcagagaaatactcttcagaagcaatgggaacattaccagagaactcaccaatatcacatttgctttcagaacacatgatacaaatgtgatgatattgcatgcagaaaaagaaccagagtttcttaatattagcattcaagatgccagattattctttcaattgcgaagtggcaacagcttttatacgctgcacctgatgggttcccaattggtgaatgatggcacatggcaccaagtgactttctccatgatagacccagtggcccagacctcccggtggcaaatggaggtgaacgaccagacaccctttgtgataagtgaagttgctactggaagcctgaactttttgaaggacaatacagacatctatgtgggtgaccaatctgttgacaatccgaaaggcctgcagggctgtctgagcacaatagagattggaggcatatatctttcttactttgaaaatctacatggtttccctggtaagcctcaggaagagcaatttctcaaagtttctacaaatatggtacttactggctgtttgccatcaaatgcctgccactccagcccctgtttgcatggaggaaactgtgaagacagctacagttcttatcggtgtgcctgtctctcgggatggtcagggacacactgtgaaatcaacattgatgagtgcttttctagcccctgtatccatggcaactgctctgatggagttgcagcctaccactgcaggtgtgagcctggatacaccggtgtgaactgtgaggtggatgtagacaattgcaagagtcatcagtgtgcaaatggggccacctgtgttcctgaagctcatggctactcttgtctctgctttggaaattttaccgggagattttgcagacacagcagattaccctcaacagtctgtgggaatgagaagagaaacttcacttgctacaatggaggcagctgctccatgttccaggaggactggcaatgtatgtgctggccaggtttcactggagagtggtgtgaagaggacatcaacgagtgtgcctccgatccctgcatcaatggaggactgtgcagggacttggtcaacaggttcctatgcatctgtgatgtggccttcgctggcgagcgctgtgagctggacctggctgatgacaggctcctgggcattttcaccgctgttggctccggaactttggccctgttcttcatcctcttgcttgctggggttgcttctcttattgcctccaacaaaagggcgactcaaggaacctacagccccagcggtcaggagaaggctggccctcgagtggaaatgtggatcaggatgccgcccccggcactggaaaggctcatctaggagactgctgctcttctcaggacagagaagaacatgatgagtaccgggtcgtgcctgagtgaagatggctttacatcactagagatacatacagctgggactgtgggaaggaccttcctgtggagtcactgagtagttatgtcatccattcacagaagagtgtccctgtgtttgcctgtcagcctcagaattagcaaaacatctagcagacagagaacacagtatttcagaagaactccagaggctgccccttaaactctttactggttgatccacataaaatgcttagtagccaagtgccattaattatacagagcc

SEQ ID NO: 52 - protein, 1405 aa, Mus musculus
MKLKRTAYLLFLYLSSSLLICIKNSFCNKNNTRCLSGPCQNNSTCKHFPQDNNCCLDTANNLDKDCEDLKDPCFSSPCQGIATCVKIPGEGNFLCQCPPGYSGLNCETATNSCGGNLCQHGGTCRKDPEHPVCICPPGYAGRFCETDHNECASSPCHNGAMCQDGINGYSCFCVPGYQGRHCDLEVDECVSDPCKNEAVCLNEIGRYTCVCPQEFSGVNCELEIDECRSQPCLHGATCQDAPGGYSCDCAPGFLGEHCELSVNECESQPCLHGGLCVDGRNSYHCDCTGSGFTGMHCESLIPLCWSKPCHNDATCEDTVDSYICHCRPGYTGALCETDINECSSNPCQFWGECVELSSEGLYGNTAGLPSSFSYVGASGYVCICQPGFTGIHCEEDVDECLLHPCLNGGTCENLPGNYACHCPFDDTSRTFYGGENCSEILLGCTHHQCLNNGKCIPHFQNGQHGFTCQCLSGYAGPLCETVTTLSFGSNGFLWVTSGSHTGIGPECNISLRFHTVQPNALLLIRGNKDVSMKLELLNGCVHLSIEVWNQLKVLLSISHNTSDGEWHFVEVTIAETLTLALVGGSCKEKCTTKSSVPVENHQSICALQDSFLGGLPMGTANNSVSVLNIYNVPSTPSFVGCLQDIRFDLNHITLENVSSGLSSNVKAGCLGKDWCESQPCQNRGRCINLWQGYQCECDRPYTGSNCLKEYVAGRFGQDDSTGYAAFSVNDNYGQNFSLSMFVRTRQPLGLLLALENSTYQYVSVWLEHGSLALQTPGSPKFMVNFFLSDGNVHLISLRIKPNEIELYQSSQNLGFISVPTWTIRRGDVIFIGGLPDREKTEVYGGFFKGCVQDVRLNSQTLEFFPNSTNNAYDDPILVNVTQGCPGDNTCKSNPCHNGGVCHSLWDDFSCSCPTNTAGRACEQVQWCQLSPCPPTAECQLLPQGFECIANAVFSGLSREILFRSNGNITRELTNITFAFRTHDTNVMILHAEKEPEFLNISIQDARLFFQLRSGNSFYTLHLMGSQLVNDGTWHQVTFSMIDPVAQTSRWQMEVNDQTPFVISEVATGSLNFLKDNTDIYVGDQSVDNPKGLQGCLSTIEIGGIYLSYFENLHGFPGKPQEEQFLKVSTNMVLTGCLPSNACHSSPCLHGGNCEDSYSSYRCACLSGWSGTHCEINIDECFSSPCIHGNCSDGVAAYHCRCEPGYTGVNCEVDVDNCKSHQCANGATCVPEAHGYSCLCFGNFTGRFCRHSRLPSTVCGNEKRNFTCYNGGSCSMFQEDWQCMCWPGFTGEWCEEDINECASDPCINGGLCRDLVNRFLCICDVAFAGERCELDLADDRLLGIFTAVGSGTLALFFILLLAGVASLIASNKRATQGTYSPSGQEKAGPRVEMWIRMPPPALERLI

SEQ ID NO: 53 - DNA, 5589 bp, Homo sapiens
ggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 54 - protein, 1679 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKKITGKDIHDTASSVARGLQFQRGLQFCTRASKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 55 - DNA, 5779 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 56 - protein, 1647 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 57 - DNA, 5703 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 58 - DNA, 5329 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 59 - protein, 1617 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 60 - DNA, 5326 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 61 - protein, 1616 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 62 - DNA, 5320 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 63 - protein, 1614 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 64 - DNA, 5317 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 65 - protein, 1613 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 66 - DNA, 6376 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaagaccctgaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 67 - protein, 1617 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 68 - DNA, 6367 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 69 - protein, 1614 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 70 - DNA, 6364 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 71 - protein, 1613 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 72 - DNA, 5892 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 73 - protein, 1590 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 74 - DNA, 5838 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 75 - protein, 1572 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 76 - DNA, 5879 bp, Homo sapiens
tcagaagaaagccccgagatcacagagacccggcgagatcacagagacccggcctgaaggaacgtggaaagaccaatgtacctgttttgaccggttgcctggagcaagaagttccagttggggagaattttcagaagataaagtcggagattgtggaaagacttgacttgcagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 77 - DNA, 5664 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 78 - protein, 1514 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 79 - DNA, 1846 bp, Homo sapiens
cttggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 80 - protein, 248 aa, Homo sapiens
MWLAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 81 - DNA, 1833 bp, Homo sapiens
attcacttcattaaatctagaggcagttgagcatgggagccgtctgtatgttgaattagggctcgcactcttgcgcaacacgtcaccagtcggaaactggggctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 82 - protein, 276 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 83 - DNA, 2254 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 84 - protein, 278 aa, Homo sapiens
MLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85 - DNA, 5831 bp, Mus musculus
ctcgctccctctgtttctgtactctgggtgactcagagagggaagattcagccagcacactgctcgcgagcaagtgtcactctgctaactggcagagccaggagacctagatgtccacacccacagacccagcagcaatgccccatcctgggccctccccggggcctggaccctctcctggaccaattctggggcctagtccaggaccaggaccatccccaggttctgtgcacagcatgatgggtcctagtcccggacctcccagcgtctcacatcctctgtcaacgatgggctctgcagacttcccacaggaaggcatgcaccaattacataagcccatggatgggatacatgacaaagggattgtagaagatgtccactgtggatccatgaagggcaccagcatgcgccccccacacccaggaatgggccctccacagagccccatggaccagcacagccaaggttatatgtcaccacatccgtctcctctgggagccccggagcacgtctctagccctatatctggaggaggcccaaccccaccccagatgccaccgagccagccaggggcactcatcccaggagatccgcaggccatgaaccagcctaacagaggtccctcgcctttcagtcctgtgcagctgcatcagcttcgagctcagattttagcttacaaaatgttggccaggggccagcctctccctgaaactctgcagctggcagtccagggaaaaaggaccttgcctggcatgcagcagcagcagcagcaacaacaacaacagcagcagcagcagcagcagcagcagcagcaacagcagcaacaacagcagccccagcagcctcagcagcaggctcaggcacagccccagcagcagcagcaacagcagcagcagccagctcttgttagctataatcgaccatctggccccgggcaggagctgctactgagtggccagagcgctccgcagaagctgtcagcaccagcaccaagcggccgaccttcaccggcaccccaggccgccgtccagcccacggccacagcggtgcccgggccctccgtgcagcagcccgccccagggcagccgtctccggtcctacagctgcaacagaagcagagccgcatcagccccatccagaaaccgcaaggcctggacccggtggagatcctgcaggaacgagagtacagacttcaagctcgcatcgctcataggatacaagaactggaaagtctgcctggttccttgccaccagatttacgcaccaaagcaaccgtggaactgaaagcacttcgcttactcaacttccaacgtcagctgagacaggaggtggtggcctgcatgcggagggacaccaccctggagacggccctcaactccaaagcatataagcggagcaagcgccagaccctgcgtgaggcacgcatgacagagaaactggagaagcagcagaagatagaacaggagaggaaacgccggcagaaacaccaggaatacctgaacagtattttgcaacatgcaaaagattttaaggaatatcaccggtctgtggccgggaagatccagaagctctccaaagcagtggcgacttggcatgctaacacagaaagggagcagaagaaggagacggagcggatcgagaaggagagaatgcggaggctgatggccgaagatgaagagggctacaggaagcttattgaccaaaagaaagacagacgtctcgcctacctattgcagcagaccgatgagtatgtcgccaatctgaccaacctggtgtgggagcacaagcaggcccaagcagccaaagagaagaagaagaggaggaggaggaagaagaaggctgaagagaatgcagagggaggggaacctgccctgggaccagatggagagccaatagatgaaagcagccagatgagtgacctgcctgtcaaagtgacacacacagaaactggcaaggtcctctttggaccagaagcacccaaagcaagtcagctggatgcctggctggagatgaatcctggttacgaagttgcacccagatctgacagtgaagagagtgaatcggactacgaggaggaggatgaagaagaagagtccagtaggcaggaaaccgaggagaagatactgctggatcccaacagtgaagaagtttccgaaaaggatgccaagcagatcattgagactgcgaagcaggacgtggacgacgaatacagcatgcagtacagtgccagaggctctcagtcctactacacggtggctcacgctatctctgagagggtggagaagcagtctgccctcctcattaacggcaccctaaagcattaccagctccagggcctggaatggatggtttccctgtataataacaatctgaacggaatcttagctgatgaaatggggctaggcaagaccatccagaccattgcactcatcacgtatctgatggagcacaaaaggctcaatggtccctacctcatcatcgtccccctctcgactctgtctaactggacatatgaatttgacaaatgggctccttctgtggtgaaaatttcttacaagggtacccctgccatgcgacgctccctcgttccccagctacggagtggcaaattcaatgtcctcctgactacttacgagtacattataaaagacaagcacattcttgcaaagattcggtggaagtacatgatcgtggacgaaggccaccggatgaagaatcaccactgcaagctaacccaggtcctgaacacacactatgtggcccccaggcggatccttctgactgggaccccactgcagaataagcttccggaactctgggccctcctcaacttcctcctccctacaatcttcaagagttgcagcacatttgagcagtggtttaatgctccatttgccatgaccggtgaaagggtggacctgaacgaagaagaaacgattttgatcatcaggcgtctacacaaggtgctgagaccctttttactgaggaggctgaagaaagaggttgagtctcagcttccggaaaaggttgagtatgtgatcaagtgtgacatgtcagctctgcagaagattctgtaccgtcacatgcaagccaaggggatcctcctcacggacgggtctgagaaagataagaaggggaaaggaggtgccaagacacttatgaacaccatcatgcagctgagaaaaatatgcaaccacccatatatgtttcagcacattgaggaatcctttgctgaacacctgggctattcgaatggggtcatcaatggggctgagctgtatcgggcctcgggaaagtttgagctgcttgatcgtattctgcccaaattgagagcgactaaccaccgcgtgctgcttttctgccagatgacgtcactcatgaccattatggaggattactttgcttttcggaacttcctgtacctgcgccttgacggcaccaccaagtctgaagatcgtgctgctttgctaaagaaattcaatgaacctgggtcccagtatttcattttcttgctgagcacaagagcagggggcctgggcttaaatcttcaggcggcagacacggtggtcatatttgacagcgactggaatcctcaccaggatctgcaggcccaagaccgagctcaccgcattggccaacaaaacgaggtccgggtgctgaggctttgcaccgtcaacagtgtggaggaaaagattctcgcggctgccaagtacaagctgaacgtggatcagaaggttatccaagcaggcatgtttgaccagaagtcatccagccacgagcggagggccttcctgcaggccattctggagcacgaggaggagaatgaggaagaagatgaggtaccagacgacgagaccctgaaccagatgattgctcgccgggaggaagaatttgatctttttatgcgcatggacatggaccggcggagggaggatgcccggaacccgaagcgcaaaccccgcttgatggaggaagatgagctgccctcctggattatcaaggatgacgccgaagtggaaaggctcacctgtgaagaagaggaggagaagatatttgggaggggctctcgccagcgccgggatgtggactacagtgatgccctcaccgagaagcaatggctcagggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaaaaaaaaaaaaaaaaaa

SEQ ID NO: 86 - protein, 1583 aa, Mus musculus
MSTPTDPAAMPHPGPSPGPGPSPGPILGPSPGPGPSPGSVHSMMGPSPGPPSVSHPLSTMGSADFPQEGMHQLHKPMDGIHDKGIVEDVHCGSMKGTSMRPPHPGMGPPQSPMDQHSQGYMSPHPSPLGAPEHVSSPISGGGPTPPQMPPSQPGALIPGDPQAMNQPNRGPSPFSPVQLHQLRAQILAYKMLARGQPLPETLQLAVQGKRTLPGMQQQQQQQQQQQQQQQQQQQQQQQQQQPQQPQQQAQAQPQQQQQQQQQPALVSYNRPSGPGQELLLSGQSAPQKLSAPAPSGRPSPAPQAAVQPTATAVPGPSVQQPAPGQPSPVLQLQQKQSRISPIQKPQGLDPVEILQEREYRLQARIAHRIQELESLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGEPALGPDGEPIDESSQMSDLPVKVTHTETGKVLFGPEAPKASQLDAWLEMNPGYEVAPRSDSEESESDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 87 - DNA, 1964 bp, Mus musculus
ttcacttcattaaatctagaggcggttcagcatgggagccgtctgtatgttgaattagggctcgctctcttgcgcaacacgtcaccagtcggaaactgggggtttgcttctgtgatttatttcattattgtgctggtaaaagctgatgaagagactagcagctcgctgctttgccggcttgttaattttatccccactaactgtgatttccgatagccggcctgctgatagtggtaagtgcggctggctctggtttaaagcaagcgtttgcaggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaa

SEQ ID NO: 88 - protein, 236 aa, Mus musculus
MEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 89 - DNA, 1979 bp, Mus musculus
acacacacacacacacacacacgcaggctgaagtatgcttaactcttttaacttggctggggctttttagcaccatatgggttctttcgtgacgtccggacccgaaagagtgcagtgtgcctttaaggaaagaggtacctcaccaaacttccctgtagttgtgcctcaccatttagctgatgaagagactagcagctcgctgctttgccggcttgttaattttatccccactaactgtgatttccgatagccggcctgctgatagtggtaaggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaaaaaaaaaaaaaaaaaa

SEQ ID NO: 90 - protein, 276 aa, Mus musculus
MKRLAARCFAGLLILSPLTVISDSRPADSGKAIEDGNLEEMEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 91 - DNA, 6369 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctaaaaaaaaaaaaaaaaa

SEQ ID NO: 92 - protein, 1210 aa, Homo sapiens [sequence omitted]

SEQ ID NO: 93 - DNA, 2239 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 94 - protein, 628 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 95 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 96 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 97 - DNA, 2865 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 98 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 99 - DNA, 3859 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagaaaaaaaaaaaaaaaa

SEQ ID NO: 100 - protein, 1091 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 101 - DNA, 3994 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagaaaaaaaaaaaaaaaa

SEQ ID NO: 102 - protein, 1136 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 103 - DNA, 6234 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctaaaaaaaaaaaaaaaaa

SEQ ID NO: 104 - protein, 1165 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 105 - DNA, 6166 bp, Homo sapiens
ccttttgaatgagctctaaaacagttctccactggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctaaaaaaaaaaaaaaaaa

SEQ ID NO: 106 - protein, 1157 aa, Homo sapiens
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 107 - DNA, 5552 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagcta

SEQ ID NO: 108 - protein, 943 aa, Homo sapiens
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 109 - DNA, 5983 bp, Mus musculus
ctcccccagtcccgacccgagctaactagacgtctgggcagccccagcgcaacgcgcagcagcctccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggccaaagataccatctattgccactgggattgtgggtggcctcctcttcatagtggtggtggcccttgggattggcctattcatgcgaagacgtcacattgttcgaaagcgtacactacgccgcctgcttcaagagagagagctcgtggaacctctcacacccagcggagaagctccaaaccaagcccacttgaggatattaaaggaaacagaattcaaaaagatcaaagttctgggttcgggagcatttggcacagtgtataagggtctctggatcccagaaggtgagaaagtaaaaatcccggtggccatcaaggagttaagagaagccacatctccaaaagccaacaaagaaatccttgacgaagcctatgtgatggctagtgtggacaaccctcatgtatgccgcctcctgggcatctgtctgacctccactgtccagctcattacacagctcatgccctacggttgcctcctggactacgtccgagaacacaaggacaacattggctcccagtacctcctcaactggtgtgtgcagattgcaaagggcatgaactacctggaagatcggcgtttggtgcaccgtgacttggcagccaggaatgtactggtgaagacaccacagcatgtcaagatcacagattttgggctggccaaactgcttggtgctgaagagaaagaatatcatgccgaggggggcaaagtgcctatcaagtggatggctttggaatcaattttacaccgaatttatacacaccaaagtgatgtctggagctatggtgtcactgtgtgggaactgatgacctttgggtccaagccttatgatggaatcccagcaagtgacatctcatccatcctagagaaaggagagcgccttccacagccacctatctgcaccatcgatgtctacatgatcatggtcaagtgctggatgatagatgctgatagccgcccaaagttccgagagttgattcttgaattctccaaaatggcccgagacccacagcgctaccttgttatccagggggatgaaagaatgcatttgccaagccctacagactccaacttttaccgagccctgatggatgaagaggacatggaggatgtagttgatgctgatgagtatcttatcccacagcaaggcttcttcaacagcccgtccacgtcgaggactcccctcttgagttctctgagtgcaactagcaacaattccactgtggcttgcattaatagaaatgggagctgccgtgtcaaagaagacgccttcttgcagcggtacagctccgaccccacaggtgctgtaacagaggacaacatagatgacgcattcctccctgtacctgaatatgtaaaccaatctgttcccaagaggccagcaggctctgtgcagaaccctgtctatcacaatcagcccctgcatccagctcctggaagagacctgcattatcaaaatccccacagcaatgcagtgggcaaccctgagtatctcaacactgcccagcctacctgtctcagtagtgggtttaacagccctgcactctggatccagaaaggcagtcaccaaatgagcctagacaaccctgactaccagcaggacttcttccccaaggaaaccaagccaaatggcatatttaagggccccacagctgaaaatgcagagtacctacgggtggcacctccaagcagtgagtttattggagcatgacaagaaggggcatcataccagctataaaatgtctggactttctagaatcccaggaccaactatggcagcacctccacttctggtagccatgcccacgctgtgtcaaatgtcactcagactggctttaaagcataactctgatgggctttgtcactgagccaagaagtgggcctctctcctgatgcactttgggaagttgaaggtacatcaattgatcttcgaactgtgaagattccacaaaaaaggtatccatcgagaacattgtccattggaacagaagtttgcctcatggtgaggtacatatgggaaaaaaacagacatatggagcttatatttagggaactttgggattcttgtctttattgatttgattgatgcactcttgtagtctggtacacagagttgcctggagccaactgaccagacagttggttccaccagctctgcatcaagacacttccgtggcaagacaactaaatgtataagaagtccatggatgccctgagcaggccacacttgtacagcattaaaccatggcagatacaataggataagccactttgttacttactggggctgggagaagaggaatgacggggtagaattttccctcagacgtactttttatataaatatgtccctggcacctaacacgcgctagtttaccagtgttttctattagacttccttctatgttttctgtttcattgttttgagttgtaaatatgtgttcctgtcttcatttcatgaagtaaacaaacaaacaaaaaacccagtattaagtattatcaaagaacaaccatgattccacattcgaacccattcaaaccatcagtattgtgaccaaaagcctttaactaagaaggagtaaccatgcaaaaatccatagaggaatttaacccaaaattttagtctcagcattgtgtctgctgaggtgtgtatatgagactacgaaagtgaactactcttcaaatccactttgccttcactcctctataccctaaatctagtgtaaaccacacatggaggataacttttttttttaattttaaaagtgtttattagatatgtttttcttcctggtaaactgcagccaaacatcagttaagagccatttttgataaacactatcacaatgatctcgggatccatcctttccgatttaccaagtgatggatagacgtgaactcataaacactacccataagacaaaacaatgagtgccagacaagacatcagccaggcaccagagcacagagcaggactgggcaatctgttggagatatctagaaagttcacaaaggaaacaagattgtccactaccttgtgagatctagcagtcataaataccagggaaatggaaagtgtgtttccttacagcaccaggtcttcgatcttcctaatgctgtgaccctttaatacagtttgccatgttgtggtgacccccaaccataaaattatttttgttgctacttcataactgtaaatttgctactcttacagaccacaatgtaaatatctgatatgctatctgatatgcaggctatctgacagaggtcgcaacccgcaggttgagagccactgccttcaaggctttaatcaagagagtagtgagctgagggctttactggtaagtcaggggcaagtccaactcaatcatcctcacatactggctgctccctcaggcctgagaatgaggcttgcagcatcctctggtttcctaaccgttatccatccctgactctcatctctgaaaatagatgtcatccatgaaattaaggagtgagaatattaagcagcatttatagagctcaaaattccatgtcatcaccaggaagtgccatgttgatcacagagaacacagaggagacatatagacagggttttgctcaaaattgggatatagaatgagcctgtcaggtacctatcaggagcggtaatccgtgagagagaaccgttgcaagccactctaactgtagcaatgaaaccctagtatttttgtactttgaaatactttcttataacaaaataaagtagcaaaaaaactgttcaaaaaaaaaaaaaaaaaaa

SEQ ID NO: 110 - protein, 1210 aa, Mus musculus
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYALAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVGLNITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNILEGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGPKIPSIATGIVGGLLFIVVVALGIGLFMRRRHIVRKRTLRRLLQERELVEPLTPSGEAPNQAHLRILKETEFKKIKVLGSGAFGTVYKGLWIPEGEKVKIPVAIKELREATSPKANKEILDEAYVMASVDNPHVCRLLGICLTSTVQLITQLMPYGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASDISSILEKGERLPQPPICTIDVYMIMVKCWMIDADSRPKFRELILEFSKMARDPQRYLVIQGDERMHLPSPTDSNFYRALMDEEDMEDVVDADEYLIPQQGFFNSPSTSRTPLLSSLSATSNNSTVACINRNGSCRVKEDAFLQRYSSDPTGAVTEDNIDDAFLPVPEYVNQSVPKRPAGSVQNPVYHNQPLHPAPGRDLHYQNPHSNAVGNPEYLNTAQPTCLSSGFNSPALWIQKGSHQMSLDNPDYQQDFFPKETKPNGIFKGPTAENAEYLRVAPPSSEFIGA

SEQ ID NO: 111 - DNA, 2678 bp, Mus musculus
ctcccccagtcccgacccgagctaactagacgtctgggcagccccagcgcaacgcgcagcagcctccctcctcttcttcccgcactgtgcgctcctcctgggctagggcgtctggatcgagtcccggaggctaccgcctcccagacagacgacaggtcacctggacgcgagcctgtgtccgggtctcgtcgttgccggcgcagtcactgggcacaaccgtgggactccgtctgtctcggattaatcccggagagccagagccaacctctcccggtcagagatgcgaccctcagggaccgcgagaaccacactgctggtgttgctgaccgcgctctgcgccgcaggtggggcgttggaggaaaagaaagtctgccaaggcacaagtaacaggctcacccaactgggcacttttgaagaccactttctgagcctgcagaggatgtacaacaactgtgaagtggtccttgggaacttggaaattacctatgtgcaaaggaattacgacctttccttcttaaagaccatccaggaggtggccggctatgtcctcattgccctcaacaccgtggagagaatccctttggagaacctgcagatcatcaggggaaatgctctttatgaaaacacctatgccttagccatcctgtccaactatgggacaaacagaactgggcttagggaactgcccatgcggaacttacaggaaatcctgattggtgctgtgcgattcagcaacaaccccatcctctgcaatatggatactatccagtggagggacatcgtccaaaacgtctttatgagcaacatgtcaatggacttacagagccatccgagcagttgccccaaatgtgatccaagctgtcccaatggaagctgctggggaggaggagaggagaactgccagaaattgaccaaaatcatctgtgcccagcaatgttcccatcgctgtcgtggcaggtcccccagtgactgctgccacaaccaatgtgctgcggggtgtacagggccccgagagagtgactgtctggtctgccaaaagttccaagatgaggccacatgcaaagacacctgcccaccactcatgctgtacaaccccaccacctatcagatggatgtcaaccctgaagggaagtacagctttggtgccacctgtgtgaagaagtgcccccgaaactacgtggtgacagatcatggctcatgtgtccgagcctgtgggcctgactactacgaagtggaagaagatggcatccgcaagtgtaaaaaatgtgatgggccctgtcgcaaagtttgtaatggcataggcattggtgaatttaaagacacactctccataaatgctacaaacatcaaacacttcaaatactgcactgccatcagcggggaccttcacatcctgccagtggcctttaagggggattctttcacgcgcactcctcctctagacccacgagaactagaaattctaaaaaccgtaaaggaaataacaggctttttgctgattcaggcttggcctgataactggactgacctccatgctttcgagaacctagaaataatacgtggcagaacaaagcaacatggtcagttttctttggcggtcgttggcctgaacatcacatcactggggctgcgttccctcaaggagatcagtgatggggatgtgatcatttctggaaaccgaaatttgtgctacgcaaacacaataaactggaaaaaactcttcgggacacccaatcagaaaaccaaaatcatgaacaacagagctgagaaagactgcaaggccgtgaaccacgtctgcaatcctttatgctcctcggaaggctgctggggccctgagcccagggactgtgtctcctgccagaatgtgagcagaggcagggagtgcgtggagaaatgcaacatcctggagggggaaccaagggagtttgtggaaaattctgaatgcatccagtgccatccagaatgtctgccccaggccatgaacatcacctgtacaggcaggggaccagacaactgcatccagtgtgcccactacattgatggcccacactgtgtcaagacctgcccagctggcatcatgggagagaacaacactctggtctggaagtatgcagatgccaataatgtctgccacctatgccacgccaactgtacctatggatgtgctgggccaggtcttcaaggatgtgaagtgtggccatctgggtacgttcaatggcagtggatcttaaagaccttttggatctaagaccagaagccatctctgactcccctctcaccttccagtttcttccaaatcctctgggccagccagaggtctcagattctgccctcttgccctgtgcccaccttgttgaccactggacagcatatgtgatggctactgctagtgccagcttcacaagaggttaacactacggactagccattcttcctatgtatctgtttctgcaaatacagccgctttacttaagtctcagcacttcttagtctcctcttttcctctcagtagcccaaggggtcatgtcacaaacatggtgtgaagggctactttgtcaaatgaaaaggtctatcttggggggcatttttttcttttctttttttcttgaaacacattgcccagcaaagccaataaatttctctcatcattttgtttctgataaattcttactattgat

SEQ ID NO: 112 - protein, 655 aa, Mus musculus
MRPSGTARTTLLVLLTALCAAGGALEEKKVCQGTSNRLTQLGTFEDHFLSLQRMYNNCEVVLGNLEITYVQRNYDLSFLKTIQEVAGYVLIALNTVERIPLENLQIIRGNALYENTYALAILSNYGTNRTGLRELPMRNLQEILIGAVRFSNNPILCNMDTIQWRDIVQNVFMSNMSMDLQSHPSSCPKCDPSCPNGSCWGGGEENCQKLTKIICAQQCSHRCRGRSPSDCCHNQCAAGCTGPRESDCLVCQKFQDEATCKDTCPPLMLYNPTTYQMDVNPEGKYSFGATCVKKCPRNYVVTDHGSCVRACGPDYYEVEEDGIRKCKKCDGPCRKVCNGIGIGEFKDTLSINATNIKHFKYCTAISGDLHILPVAFKGDSFTRTPPLDPRELEILKTVKEITGFLLIQAWPDNWTDLHAFENLEIIRGRTKQHGQFSLAVVGLNITSLGLRSLKEISDGDVIISGNRNLCYANTINWKKLFGTPNQKTKIMNNRAEKDCKAVNHVCNPLCSSEGCWGPEPRDCVSCQNVSRGRECVEKCNILEGEPREFVENSECIQCHPECLPQAMNITCTGRGPDNCIQCAHYIDGPHCVKTCPAGIMGENNTLVWKYADANNVCHLCHANCTYGCAGPGLQGCEVWPSGYVQWQWILKTFWI

SEQ ID NO: 113 - DNA, 42 bp, Unknown
  Description of Unknown: SAFB2 sequence
agcggcgggtgaagtgggggtacggggggggatgagggtgtg

SEQ ID NO: 114 - protein, 10 aa, Unknown
  Description of Unknown: SAFB2 sequence
RRVKWGYGGG

SEQ ID NO: 115 - protein, 10 aa, Unknown
  Description of Unknown: SAFB2 sequence
SGGTGGDEGV

SEQ ID NO: 116 - protein, 14 aa, Unknown
  Description of Unknown: SAFB2 sequence
AAGEVGVRGGMRVW

SEQ ID NO: 117 - protein, 14 aa, Unknown
  Description of Unknown: SAFB2 sequence
RRTFHPYPPPHPHP

What is claimed is:

1. A method of treating melanoma, non-small cell lung cancer (NSCLC), or head and neck squamous cell carcinoma (HNSCC) in a subject likely to be responsive to immune checkpoint therapy against PD-1 or CTLA-4, the method comprising:
   i) selecting the subject, the subject having been identified according to:
      a) determining the copy number of ARID2 in a sample from the subject having cancer selected from the group consisting of melanoma, non-small cell lung cancer (NSCLC), and head and neck squamous cell carcinoma (HNSCC), wherein the sample comprises nucleic acid molecules from the subject's cancer; and
      b) comparing said copy number to that of a control sample,
      wherein an increased copy number of ARID2 encoding a loss of function mutation in the subject sample, relative to the control sample identifies the cancer as being more likely to be responsive to the immune checkpoint therapy against PD-1 or CTLA-4; and
   ii) administering the immune checkpoint therapy against PD-1 or CTLA-4 to the selected subject.

2. The method of claim 1, wherein the control sample is determined from a non-cancerous sample from either the subject or a member of the same species to which the subject belongs.

3. The method of claim 2, wherein the control sample is a non-cancerous sample from the subject obtained from an earlier point in time than the subject sample.

4. The method of claim 3, wherein the control sample is obtained before the subject has received immune checkpoint therapy and the subject sample is obtained after the subject has received immune checkpoint therapy.

5. The method of claim 2, wherein the control sample does not comprise cells.

6. The method of claim 2, wherein the control sample comprises cells.

7. The method of claim 6, wherein the cells are cancer cells known to be non-responsive to the immune checkpoint therapy.

8. The method of claim 1, wherein the subject sample and/or the control sample has not been contacted with a renal cell cancer treatment or an inhibitor of an immune checkpoint.

9. The method of claim 1, wherein the subject has not been administered a renal cell cancer treatment or an inhibitor of an immune checkpoint.

10. The method of claim 1, wherein the subject sample is selected from the group consisting of serum, whole blood, plasma, urine, cells, cell lines, and biopsies.

11. The method of claim 1, further comprising recommending, prescribing, or administering at least one additional anti-cancer therapeutic agent.

12. The method of claim 1, wherein the immune checkpoint therapy comprises at least one antibody selected from the group consisting of anti-PD-1 antibodies, anti-CTLA-4 antibodies, and combinations thereof.

13. The method of claim 12, wherein the immune checkpoint therapy comprises an anti-PD-1 antibody.

14. The method of claim 12, wherein the immune checkpoint therapy comprises an anti-CTLA4 antibody.

15. The method of claim 1, wherein the likelihood of the cancer in the subject being responsive to immune checkpoint therapy is indicated by at least one of cellular proliferation, tumor burden, m-stage, metastasis, progressive disease, clinical benefit rate, survival until mortality, pathological complete response, semi-quantitative measures of pathologic response, clinical complete remission, clinical partial remission, clinical stable disease, recurrence-free survival, metastasis free survival, disease free survival, circulating tumor cell decrease, circulating marker response, and RECIST criteria.

16. The method of claim 1, wherein the subject is a mammal.

17. The method of claim 16, wherein mammal is an animal model of the cancer.

18. The method of claim 16, wherein the mammal is a human.

* * * * *